US007638136B2

(12) United States Patent
Meinke et al.

(10) Patent No.: US 7,638,136 B2
(45) Date of Patent: Dec. 29, 2009

(54) STREPTOCOCCUS PYOGENE ANTIGENS

(75) Inventors: Andreas Meinke, Pressbaum (AT); Eszter Nagy, Vienna (AT); Birgit Winkler, Vienna (AT); Dieter Gelbmann, Andau (AT)

(73) Assignee: Intercell AG, Vienna (AT)

( * ) Notice: Subject to any disclaimer, the term of this patent is extended or adjusted under 35 U.S.C. 154(b) by 0 days.

(21) Appl. No.: 10/548,463

(22) PCT Filed: Mar. 2, 2004

(86) PCT No.: PCT/EP2004/002087

§ 371 (c)(1),
(2), (4) Date: Sep. 2, 2005

(87) PCT Pub. No.: WO2004/078907

PCT Pub. Date: Sep. 16, 2004

(65) Prior Publication Data

US 2006/0194751 A1      Aug. 31, 2006

(30) Foreign Application Priority Data

Mar. 4, 2003  (EP)  .................................. 03450061

(51) Int. Cl.
*A61K 39/09* (2006.01)
*C07K 14/00* (2006.01)
*C07K 4/04* (2006.01)
*C12P 21/04* (2006.01)
*C07H 21/04* (2006.01)

(52) U.S. Cl. .................. 424/244.1; 424/184.1; 530/300; 530/350; 435/69.1; 435/69.7; 435/320.1; 536/23.1; 536/23.7

(58) Field of Classification Search ................ 435/69.3, 435/69.7, 253.4; 536/23.7; 530/300, 350; 424/190.1, 197, 237.1, 244.1
See application file for complete search history.

(56) References Cited

U.S. PATENT DOCUMENTS 4,946,778 A     8/1990   Ladner et al.

FOREIGN PATENT DOCUMENTS

| AU | A 1924/2001 | 6/2003 |
|---|---|---|
| CA | 2045869 | 12/1991 |
| EP | A-0 464 533 | 1/1992 |
| GB | WO0234771 | * 2/2002 |
| WO | 96/02555 | 2/1996 |
| WO | 97/30721 | 8/1997 |
| WO | 99/38528 | 8/1999 |
| WO | 01/24822 | 4/2001 |
| WO | 01/54720 | 8/2001 |
| WO | 01/93903 | 12/2001 |
| WO | 01/93905 | 12/2001 |
| WO | 02/05448 | 1/2002 |
| WO | 02/13857 | 2/2002 |
| WO | 02/059148 | 8/2002 |

OTHER PUBLICATIONS (Ellis, R.W. (Chapter 29 of "Vaccines" Plotkin, 5.A. et al. (eds) published by W. B. Saunders company (Philadelphia) in 1988, especially p. 571.*
Berneman et al Infect Immun. 1998, 66, 4163-4168.*
Accession No. ABP25483.*
Colman et al (Research in Immunology, 1994; 145(1): 33-36.*
Abaza et al. Journal of Protein Chemistry, vol. 11, No. 5, 1992, pp. 433-444.*
Altschul, S., et al. (1990). Journal of Molecular Bology 215: 403-10.
Bennett, D.; et al. "Kinetic Characterization of the Interaction of Biotinylated Human Interleukin 5 with and Fc Chimera of its Receptors a Subunit and Development of an ELISA Screening Assay using Real-Time Interaction Biosensor Analysis" Journal of Molecular Recognition 8:52-58 (1995).
Bessen, D., et al. (1988). "Influence of intranasal immunization with synthetic peptides corresponding to conserved epitopes of M protein on mucosal colonization by group A streptococci." Infect Immun 56: 2666-2672.
Bisno, A, et d. (1987). "M proteins of group G streptococci isolated from bacteremic human infections." Infect lmmun 55: 753-7.
Bronze, M., et al. (1988). "Protective immunity evoked by locally administered group A streptococcal vaccines in mice" J Immunol 141: 2767-2770.
Clackson, T., et al. (1991). "Making antibody fragments using phage display libraries" Nature 352: 624-8.
Cone, L., et al. Clinical and Bacteriologic Observations of a Toxic Shock-Like Syndrome Due to Streptococcus Pyogenes New Engl J Med 317: 146-9 (1987).
Cunningham, M. (2000). "Pathogenesis of Group A Streptococcal Infections" Clin Microbiol Rev 13: 470-511.
Devereux, J., et al. (1984). "A comprehensive set of sequence analysis programs for the VAX" Nucleic acids research 12: 387-95.
Doherty, E., et al. "Ribozyme Structures and Mechanisms " Annu Rev Biophys Biomol Struct 30: 457-475 (2001).
Eisenbraun, M., et al. "Examination of Parameters Affecting the Elicitation of Humoral Immune Responses by Particle Bombardment-Mediated Genetic Immunization" DNA Cell Biol12.791-7 (1993).
Enright M., et al. (2001) "Multilocus Sequence Typing of Streptococcus pyogenes and the Relationships between emm Type and Clone" Inf. Immun. 69: 2416-27.
Etz, H., et al. (2001). "Bacterial Phage Receptors, Versatile Tools for Display of Polypeptides on the Cell Surface" J Bacteriol 183: 6924-35.
Fenderson, P., et al. (1989). "Tropomyosin shares immunologic epitopes with group A streptococcal M proteins" J Immunol 142: 2475-2481.
Fischetti, V. (1989). "Streptococcal M protein: molecular design and biological behavior" Clin Microbiol Rev 2: 285-314.

(Continued)

*Primary Examiner*—Robert B Mondesi
*Assistant Examiner*—Padma V Baskar
(74) *Attorney, Agent, or Firm*—Fulbright & Jaworski L.L.P.

(57) ABSTRACT

The present invention discloses isolated nucleic acid molecules encoding a hyperimmune serum reactive antigen or a fragment thereof as well as hyperimmune serum reactive antigens or fragments thereof from S. pyogenes, methods for isolating such antigens and specific uses therefore.

16 Claims, 10 Drawing Sheets

OTHER PUBLICATIONS

Ganz, T. (1999). Science 286: 420-421.
Georgiou, G. (1997). "Display of heterologous proteins on the surface of microorganisms: From the screening of combinatorial libraries to live recombinant vaccines" Nature Biotechnology 15: 29-34.
Guzrnan, C., et al. (1999). "Protective Immune Response against Streptococcus pyogenes in Mice after Intranasal Vaccination with the Fibronectin-Binding Protein Sfbl" J Infect Dis 179: 901-6.
Hashemzadeh-Bonehi, L., et al. "MicroCorrespondence" Mol Microbiol 30: 676-678 (1998).
Vittali et al., "PCR M Typing: a New Method for Rapid Typing of Group A Streptococci" Journal of Clinical Microbiology 40(2)679-681 (Feb. 2002).
Hemmer, B., et al. (1999). "Identification of candidate T-cell epitopes and molecular mimics in chronic Lyme disease" Nat Med 5: 1375-82.
Hoe N., et al. (2001) "Distribution of Streptococcal Inhibitor of Complement Variants in Pharyngitis and Invasive Isolates in an Epidemic of Serotype M1 Group A Streptococcus Infection" J.M.Dis, 183: 633-9.
Hope-Simpson, R. "Streptococcus pyogenes in the throat: a study in a small population" J. Hyg (Lond) 87: 109-29 (1981).
Ji, Y., et al. (1997). "Intranasal immunization with C5a peptidase prevents nasopharyngeal colonization of mice by the group A Streptococcus" Infect Immun 65: 2080-2087.
Johanson, K., et al. (1995). "Binding Interactions of Human Interleukin 5 with Its Receptor Subunit" J Biol Chem 270: 9459-71.
Jones, P., et al. "Replacing the complementarity-determining regions in a human antibody with those from a mouse" Nature 321: 522-5 (1986).
Kajava, A, et al. (2000). "The Net Charge of the First 18 Residues of the Mature Sequence Affects Protein Translocation across the Cytoplasmic Membrane of Gram-Negative Bacteria" J Bacterial 182: 2163-9.
Kohler, G., et al. (1975). "Continuous cultures of fused cells secreting antibody of predefined specificity" Nature 256: 495-7.
Kolaskar, A., et al. (1990). "A semi-empirical method for prediction of antigenic determinants on protein antigens" FEBS Lett 276: 172-4.
Lee, P. K (1989). "Quantification and toxicity of group A streptococcal pyrogenic exotoxins in an animal model of toxic shock syndrome-like illness." J Clin Microbiol 27: 1890-2.
Lewin, A., et al. (2001). "Ribozyme gene therapy: applications for molecular medicine" Trends Mol Med 7: 221-8.
Marks, J., et al. (1992) "By-Passing Immunization: Building High Affinity Human Antibodies by Chain Shuffling" Biotechnology (NY) 10: 779-83.
McCafferty, J., et al. (1990) "Phage antibodies: filamentous phage displaying antibody variable domains" Nature 348: 552-4.
Okano, H., et al. (1991) "Myelin Basic Protein Gene and the Function of Antisense RNA in Its Repression in Myelin-Deficient Mutant Mouse" J Neurochem 56: 560-7.
Orange et al., "Pneumococcal Serotypes Causing Disease in Children in Alabama" The Pediatric Infectious Disease Journal 12(3)244-246 (Mar. 1993).
Phillips-Quagliata, J., et al. (2000). "The IgA/IgM Receptor Expressed on a Murine B Cell Lymphoma Is Poly-Ig Receptor" J Immunol 165: 2544-55.
Rammensee, H., et al. (1999). "SYFPEITHI: database for MHc ligands and peptide motifs" Immunogenetics 50: 213-9.
Rosenshine, I., et al. (1992). "Tyrosine protein kinase inhibitors block invasin-promoted bacterial uptake by epithelial cells" Infect Immun 60: 2211-7.
Seeger, C., et al. (1984). "The Cloned Genome of Ground Squirrel Hepatitis Virus is Infectious in the Animal" Proc Natl Acad Sci USA 81: 5849-52.
Shibuya, A, et al. (2000). "Fc/ receptor mediates endocytosis of IgM-coated microbes" Nature Immunology 1:441-6.
Skerra, A. (1994). "Use of the tetracycline promoter for the tightly regulated production of a murine antibody fragment in *Escherichia coli*" Gene 151: 131-5.
Stevens, D. (1992). "Invasive Group A Streptococcus Infections" Clin Infect Dis 14: 2-11.
Tang, D., et al. (1992). "Genetic immunization is a simple method for eliciting an immune response" Nature 356: 152-4.
Tempest, P., et al., (1991). "Reshaping a Human Monoclonal Antibody to Inhibit Human Respiratory Syncytial Virus Infection in Vivo" Biotechnology (N Y) 9: 266-71.
Tourdot, S., et al. (2000). "A general strategy to enhance immunogenicity of low-affinity HLA-A2.1-associated peptides: implication in the identification of cryptic tumor epitopes" Eur J Immunol 30: 3411-21.
Whitnack, E., et al. (1985). "Inhibition of Complement-Mediated Opsonization and Phagocytosis of Streptococcus Pyogenes by D Fragments of Fibrinogen and Fibrin Bound to Cell Surface M Protein" J Exp Med 162: 1983-97.
Gray et al., "Serotypes of Streptococcus Pneumoniae Causing Disease" Journal of Infectious Diseases 140(6) Dec. 1979.
Gray et al., "Clinical and epidemiologic studies of pneumococcal infection in children" Pediatric Infectious Disease 5(2) 201-207 (1986).
Talkington et al., Protection of mice against fatal pneumococcal challenge by immunization with pneumococcal surface adhesin A (PsaA). *Microbial Pathogenesis* vol. 21, Issue 1, Jul. 1996, pp. 17-22.
Tettelin et al., "Complete Genome Sequence of a Virulent Isolate of Streptococcus pneumonia" Science 293:498-506 (Jul. 20, 2001).

* cited by examiner

STREPTOCOCCUS PYOGENE ANTIGENS

CROSS-REFERENCE TO PRIORITY CLAIM

This application is a U.S. national phase application of International (PCT) Application No. PCT/EP2004/002087, filed Mar. 2, 2004, which claims priority to European Patent Application No. 03450061.1, filed Mar. 4, 2003.

The sequence listing filename "05-685_SubsSeqList.txt", 652,174 bytes in size, created on Aug. 16, 2008 and submitted electronically on Sep. 4, 2008 using EFS-Web 1.1 is incorporated into the specification.

The present invention relates to isolated nucleic acid molecules, which encode antigens for *Streptococcus pyogenes*, which are suitable for use in preparation of pharmaceutical medicaments for the prevention and treatment of bacterial infections caused by *Streptococcus pyogenes*.

*Streptococcus pyogenes*, also called group A *streptococci* (GAS), is an important gram-positive extracellular bacterial pathogen and commonly infects humans. GAS colonize the throat or skin and are responsible for a number of suppurative infections and non-suppurative sequelae. It is primarily a disease of children and causes a variety of infections including bacterial pharyngitis, scarlet fever, impetigo and sepsis in humans. Decades of epidemiological studies have led to the concept of distinct throat and skin strains, where certain serotypes are often associated with throat or skin infections, respectively {Cunningham, M., 2000}. GAS have been discovered responsible for *streptococcal* toxic shock syndrome associated necrotizing fasciitis which is recently resurgent in the USA {Cone, L. et al., 1987; Stevens, D., 1992} and has been described as the "flesh eating" bacterium which invades skin and soft tissues leading to tissue or limb destruction.

Several post-*streptococcal* sequelae may occur in humans subsequent to infection, such as acute rheumatic fever, acute glomerulonephritis and reactive arthritis. Acute rheumatic fever and rheumatic heart disease are of these the most serious autoimmune sequelae and have led to disability and death of children worldwide. *S. pyogenes* can also causes severe acute diseases such as scarlet fever and necrotizing fasciitis and has been associated with Tourette's syndrome, tics and movement and attention disorders.

Group A *streptococci* are the most common bacterial cause of sore throat and pharyngitis and account for at least 16% of all office calls in a general medical practice, season dependent {Hope-Simpson, R., 1981}. It primarily affects children in school-age between 5 to 15 years of age {Cunningham, M., 2000}. All ages are susceptible to spread of the organism under crowded conditions, for example in schools. GAS are not considered normal flora though, but pharyngeal carriage of group A *streptococci* can occur without clinical symptoms.

Group A *streptococci* can be distinguished by the Lancefield classification scheme of serologic typing based on their carbohydrate or classified into M protein serotypes based on a surface protein that can be extracted by boiling bacteria with hydrochloric acid. This has led to the identification of more than 80 serotypes, which can also be typed by a molecular approach (emm genes). Certain M protein serotypes of *S. pyogenes* are mainly associated with pharyngitis and rheumatic fever, while others mainly seem to cause pyoderma and acute glomerulonephritis {Cunningham, M., 2000}.

Also implicated in causing pharyngitis and occasionally toxic shock are group C and G *streptococci*, which must be distinguished after throat culture {Hope-Simpson, R., 1981; Bisno, A. et al., 1987}. Currently, *streptococcal* infections can only be treated by antibiotic therapy. However, 25-30% of those treated with antibiotics show recurrent disease and/or shed the organism in mucosal secretions. There is at present no preventive treatment (vaccine) available to avoid *streptococcal* infections.

Thus, there remains a need for an effective treatment to prevent or ameliorate *streptococcal* infections. A vaccine could not only prevent infections by *streptococci*, but more specifically prevent or ameliorate colonization of host tissues, thereby reducing the incidence of pharyngitis and other suppurative infections. Elimination of non-suppurative sequelae such as rheumatic fever, acute glomerulonephritis, sepsis, toxic shock and necrotizing fasciitis would be a direct consequence of reducing the incidence of acute infection and carriage of the organism. Vaccines capable of showing cross-protection against other *streptococci* would also be useful to prevent or ameliorate infections caused by all other beta-hemolytic *streptococcal* species, namely groups A, B, C and G.

A vaccine can contain a whole variety of different antigens. Examples of antigens are whole-killed or attenuated organisms, subfractions of these organisms/tissues, proteins, or, in their most simple form, peptides. Antigens can also be recognized by the immune system in form of glycosylated proteins or peptides and may also be or contain polysaccharides or lipids. Short peptides can be used since for example cytotoxic T-cells (CTL) recognize antigens in form of short usually 8-11 amino acids long peptides in conjunction with major histocompatibility complex (MHC). B-cells can recognize linear epitopes as short as 4-5 amino acids, as well as three-dimensional structures (conformational epitopes). In order to obtain sustained, antigen-specific immune responses, adjuvants need to trigger immune cascades that involve all cells of the immune system necessary. Primarily, adjuvants are acting, but are not restricted in their mode of action, on so-called antigen presenting cells (APCs). These cells usually first encounter the antigen(s) followed by presentation of processed or unmodified antigen to immune effector cells. Intermediate cell types may also be involved. Only effector cells with the appropriate specificity are activated in a productive immune response. The adjuvant may also locally retain antigens and co-injected other factors. In addition the adjuvant may act as a chemoattractant for other immune cells or may act locally and/or systemically as a stimulating agent for the immune system.

Approaches to develop a group A *streptococcal* vaccine have focused mainly on the cell surface M protein of *S. pyogenes* {Bessen, D. et al., 1988; Bronze, M. et al., 1988}. Since more than 80 different M serotypes of *S. pyogenes* exist and new serotypes continually arise {Fischetti, V., 1989}, inoculation with a limited number of serotype-specific M protein or M protein derived peptides will not likely be effective in protecting against all other M serotypes. Furthermore, it has been shown that the M protein contains an amino acid sequence, which is immunologically cross-reactive with human heart tissue, which is thought to account for heart valve damage associated with rheumatic fever {Fenderson, P. et al., 1989}.

There are other proteins under consideration for vaccine development, such as the erythrogenic toxins, *streptococcal* pyrogenic exotoxin A and *streptococcal* pyrogenic exotoxin B {Lee, P. K., 1989}. Immunity to these toxins could possibly prevent the deadly symptoms of *streptococcal* toxic shock, but it may not prevent colonization by group A *streptococci*.

The use of the above described proteins as antigens for a potential vaccine as well as a number of additional candidates {Ji, Y. et al., 1997; Guzman, C. et al., 1999} resulted mainly from a selection based on easiness of identification or chance of availability. There is a demand to identify efficient and relevant antigens for *S. pyogenes*.

The present inventors have developed a method for identification, isolation and production of hyperimmune serum reactive antigens from a specific pathogen, especially from *Staphylococcus aureus* and *Staphylococcus epidermidis* (WO 02/059148). However, given the differences in biological property, pathogenic function and genetic background, *Streptococcus pyogenes* is distinctive from *Staphylococcus* strains. Importantly, the selection of sera for the identification of antigens from *S. pyogenes* is different from that applied to the *S. aureus* screens. Three major types of human sera were collected for that purpose. First, healthy adults below <45 years of age preferably with small children in the household were tested for nasopharyngeal carriage of *S. pyogenes*. A large percentage of young children are carriers of *S. pyogenes*, and they are considered a source for exposure for their family members. Based on correlative data, protective (colonization neutralizing) antibodies are likely to be present in exposed individuals (children with high carriage rate in the household) who are not carriers of *S. pyogenes*. To be able to select for relevant serum sources, a series of ELISAs measuring anti-*S. pyogenes* IgG and IgA antibody levels were performed with bacterial lysates and culture supernatant proteins. Sera from high titer non-carriers were included in the genomic based antigen identification. This approach for selection of human sera is basically very different from that used for *S. aureus*, where carriage or noncarriage state cannot be associated with antibody levels.

Second, serum samples from patients with pharyngitis were characterized and selected in the same way. The third group of serum samples obtained from individuals with post-*streptococcal* sequellae—such as acute rheumatic fever and glomerulonephritis—were used mainly for validation purposes. This latter group helps in the exclusion of epitopes, which induce high levels of antibodies in these patients, since post-streptococcal disease is associated with antibodies induced by GAS and reactive against human tissues, such as heart muscle, or involved in harmful immune complex formation in the kidney glomeruli. The genomes of the two bacterial species *S. pyogeizes* and *S. aureus* by itself show a number of important differences. The genome of *S. pyogeizes* contains app. 1.85 Mb, while *S. aureus* harbours 2.85 Mb. They have an average GC content of 38.5 and 33%, respectively and approximately 30 to 45% of the encoded genes are not shared between the two pathogens. In addition, the two bacterial species require different growth conditions and media for propagation. While *S. pyogenes* is a strictly human pathogen, *S. aureus* can also be found infecting a range of warm-blooded animals. A list of the most important diseases, which can be inflicted by the two pathogens is presented below. *S. aureus* causes mainly nosocomial, opportunistic infections: impetigo, folliculitis, abscesses, boils, infected lacerations, endocarditis, meningitis, septic arthritis, pneumonia, osteomyelitis, scalded skin syndrome (SSS), toxic shock syndrome. *S. pyogenes* causes mainly community acquired infections: streptococcal sore throat (fever, exudative tonsillitis, pharyngitis), streptococcal skin infections, scarlet fever, puerperal fever, septicemia, erysipelas, perianal cellulitis, mastoiditis, otitis media, pneumonia, peritonitis, wound infections, acute glomerulonephritis, acute rheumatic fever; toxic shock-like syndrome, necrotizing fasciitis.

The problem underlying the present invention was to provide means for the development of medicaments such as vaccines against *S. pyogenes* infection. More particularly, the problem was to provide an efficient, relevant and comprehensive set of nucleic acid molecules or hyperimmune serum reactive antigens from *S. pyogenes* that can be used for the manufacture of said medicaments.

Therefore, the present invention provides an isolated nucleic acid molecule encoding a hyperimmune serum reactive antigen or a fragment thereof comprising a nucleic acid sequence which is selected from the group consisting of:
  a) a nucleic acid molecule having at least 70% sequence identity to a nucleic acid molecule selected from Seq ID No 1, 4-8, 10-18, 20, 22, 24-32, 34-35, 38-40, 43-46, 49-51, 53-54, 57-61, 63, 65-71, 73 75-77, 81-82, 88, 91-94 and 96-150.
  b) a nucleic acid molecule which is complementary to the nucleic acid molecule of a),
  c) a nucleic acid molecule comprising at least 15 sequential bases of the nucleic acid molecule of a) or b)
  d) a nucleic acid molecule which anneals under stringent hybridisation conditions to the nucleic acid molecule of a), b), or c)
  e) a nucleic acid molecule which, but for the degeneracy of the genetic code, would hybridise to the nucleic acid molecule defined in a), b), c) or d).

According to a preferred embodiment of the present invention the sequence identity is at least 80%, preferably at least 95%, especially 100%.

Furthermore, the present invention provides an isolated nucleic acid molecule encoding a hyperimmune serum reactive antigen or a fragment thereof comprising a nucleic acid sequence selected from the group consisting of
  a) a nucleic acid molecule having at least 96% sequence identity to a nucleic acid molecule selected from Seq ID No 64,
  b) a nucleic acid molecule which is complementary to the nucleic acid molecule of a),
  c) a nucleic acid molecule comprising at least 15 sequential bases of the nucleic acid molecule of a) or b)
  d) a nucleic acid molecule which anneals under stringent hybridisation conditions to the nucleic acid molecule of a), b) or c),
  e) a nucleic acid molecule which, but for the degeneracy of the genetic code, would hybridise to the nucleic acid defined in a), b), c) or d).

According to another aspect, the present invention provides an isolated nucleic add molecule comprising a nucleic add sequence selected from the group consisting of
  a) a nucleic add molecule selected from Seq ID No 3, 36, 47-48, 55, 62, 72, 80, 84, 95.
  b) a nucleic acid molecule which is complementary to the nucleic add of a),
  c) a nucleic add molecule which, but for the degeneracy of the genetic code, would hybridise to the nucleic acid defined in a), b), c) or d).

Preferably, the nucleic add molecule is DNA or RNA.

According to a preferred embodiment of the present invention, the nucleic add molecule is isolated from a genomic DNA, especially from a *S. pyogenes* genomic DNA.

According to the present invention a vector comprising a nucleic acid molecule according to any of the present invention is provided.

In a preferred embodiment the vector is adapted for recombinant expression of the hyperimmune serum reactive antigens or fragments thereof encoded by the nucleic acid molecule according to the present invention.

The present invention also provides a host cell comprising the vector according to the present invention.

According to another aspect the present invention further provides a hyperimmune serum-reactive antigen comprising an amino acid sequence being encoded by a nucleic acid molecule according to the present invention In a preferred embodiment the amino acid sequence (polypeptide) is selected from the group consisting of Seq ID No 151, 154-158, 160-168, 170, 172, 174-182, 184-185, 188-190, 193-196, 199-201, 203-204, 207-211, 213, 215-221, 223, 225-227, 231-232, 238, 241-244 and 246-300.

In another preferred embodiment the amino acid sequence (polypeptide) is selected from the group consisting of Seq ID No 214

In a further preferred embodiment the amino acid sequence (polypeptide) is selected from the group consisting of Seq ID No 153, 186, 197-198, 205, 212, 222, 230, 234, 245.

According to a further aspect the present invention provides fragments of hyperimmune serum-reactive antigens selected from the group consisting of peptides comprising amino acid sequences of column "predicted immunogenic aa" and "location of identified immunogenic region" of Table 1; the serum reactive epitopes of Table 2, especially peptides comprising amino acids 4-44, 57-65, 67-98, 101-107, 109-125, 131-144, 146-159, 168-173, 181-186, 191-200, 206-213, 229-245, 261-269, 288-301, 304-317, 323-328, 350-361, 374-384, 388-407, 416-425 and 1-114 of Seq ID No 151; 5-17, 49-64, 77-82, 87-98, 118-125, 127-140, 142-150, 153-159, 191-207, 212-218, 226-270, 274-287, 297-306, 325-331, 340-347, 352-369, 377-382, 390-395 and 29-226 of Seq ID No 152; 4-16, 20-26, 32-74, 76-87, 93-108, 116-141, 148-162, 165-180, 206-219, 221-228, 230-236, 239-245, 257-268, 313-328, 330-335, 353-359, 367-375, 394-403, 414-434, 437-444, 446-453, 356-464, 478-487, 526-535, 541-552, 568-575, 577-584, 589-598, 610-618, 624-643, 653-665, 667-681, 697-718, 730-748, 755-761, 773-794, 806-821, 823-831, 837-845, 862-877, 879-889, 896-919, 924-930, 935-940, 947-955, 959-964, 969-986, 991-1002, 1012-1036, 1047-1056, 1067-1073, 1079-1085, 1088-1111, 1130-1135, 1148-1164, 1166-1173, 1185-1192, 1244-1254 and 919-929 of Seq ID No 153; 5-44, 62-74, 78-83, 99-105, 107-113, 124-134, 161-174, 176-194, 203-211, 216-237, 241-247, 253-266, 272-299, 323-349, 353-360 and 145-305 of Seq ID No 154; 15-39, 52-61, 72-81, 92-97 and 71-81 of Seq ID No 155; 13-19, 21-31, 40-108, 115-122, 125-140, 158-180, 187-203, 210-223, 235-245 and 173-186 of Seq ID No 156; 5-12, 19-27, 29-39, 59-67, 71-78, 80-88, 92-104, 107-124, 129-142, 158-168, 185-191, 218-226, 230-243, 256-267, 272-277, 283-291, 307-325, 331-334, 346-352 and 316-331 of Seq ID No 157; 6-28, 43-53, 60-76, 93-103 and 21-99 of Seq ID No 158; 10-30, 120-126, 145-151, 159-169, 174-182, 191-196, 201-206, 214-220, 222-232, 254-272, 292-307, 313-323, 332-353, 361-369, 389-369, 401-415, 428-439, 465-481, 510-517, 560-568 and 9-264 of Seq ID No 159; 5-29, 39-45, 107-128 and 1-112 of Seq ID No 160; 4-38, 42-50, 54-60, 65-71, 91-102 and 21-56 of Seq ID No 161; 4-13, 19-25, 41-51, 54-62, 68-75, 79-89, 109-122, 130-136, 172-189, 192-198, 217-224, 262-268, 270-276, 281-298, 315-324, 333-342, 353-370, 376-391 and 23-39 of Seq ID No 162; 6-41, 49-58, 62-103, 117-124, 147-166, 173-194, 204-211, 221-229, 255-261, 269-284, 288-310, 319-325, 348-380, 383-389, 402-410, 424-443, 467-479, 496-517, 535-553, 555-565, 574-581, 583-591 and 474-489 of Seq ID No 163; 8-35, 52-57, 66-73, 81-88, 108-114, 125-131, 160-167, 174-180, 230-235, 237-249, 254-262, 278-285, 308-314, 321-326, 344-353, 358-372, 376-383, 393-411, 439-446, 453-464, 471-480, 485-492, 502-508, 523-529, 533-556, 558-563, 567-584, 589-597, 605-619, 625-645, 647-666, 671-678, 690-714, 721-728, 741-763, 766-773, 777-787, 792-802, 809-823, 849-864 and 37-241, 409-534, 582-604, 743-804 of Seq ID No 164; 4-17, 24-36, 38-44, 59-67, 72-90, 92-121, 126-149, 151-159, 161-175, 197-215, 217-227, 241-247, 257-264, 266-275, 277-284, 293-307, 315-321, 330-337, 345-350, 357-366, 385-416 and 202-337 of Seq ID No 165; 4-20, 22-46, 49-70, 80-89, 96-103, 105-119, 123-129, 153-160, 181-223, 227-233, 236-243, 248-255, 261-269, 274-279, 283-299, 305-313, 315-332, 339-344, 349-362, 365-373, 380-388, 391-397, 402-407 and 1-48 of Seq ID No 166; 18-37, 41-63, 100-106, 109-151, 153-167, 170-197, 199-207, 212-229, 232-253, 273-297 and 203-217 of Seq ID No 167; 20-26, 54-61, 80-88, 94-101, 113-119, 128-136, 138-144, 156-188, 193-201, 209-217, 221-229, 239-244, 251-257, 270-278, 281-290, 308-315, 319-332, 339-352, 370-381, 388-400, 411-417, 426-435, 468-482, 488-497, 499-506, 512-521 and 261-273 of Seq ID No 168; 6-12, 16-36, 50-56, 86-92, 115-125, 143-152, 163-172, 193-203, 235-244, 280-289, 302-315, 325-348, 370-379, 399-405, 411-417, 419-429, 441-449, 463-472, 482-490, 500-516, 536-543, 561-569, 587-594, 620-636, 647-653, 659-664, 677-685, 687-693, 713-719, 733-740, 746-754, 756-779, 792-799, 808-817, 822-828, 851-865, 902-908, 920-938, 946-952, 969-976, 988-1005, 1018-1027, 1045-1057, 1063-1069, 1071-1078, 1090-1099, 1101-1109, 1113-1127, 1130-1137, 1162-1174, 1211-1221, 1234-1242, 1261-1268, 1278-1284, 1312-1317, 1319-1326, 1345-1353, 1366-1378, 1382-1394, 1396-1413, 1415-1424, 1442-1457, 1467-1474, 1482-1490, 1492-1530, 1537-1549, 1559-1576, 1611-1616, 1624-1641 and 1-414, 443-614, 997-1392 of Seq ID No 169; 14-42, 70-75, 90-100, 158-181 and 1-164 of Seq ID No 170; 4-21, 30-36, 54-82, 89-97, 105-118, 138-147 and 126-207 of Seq ID No 171; 4-21, 31-66, 96-104, 106-113, 131-142 and 180-204 of Seq ID No 172; 5-23, 31-36, 38-55, 65-74, 79-88, 101-129, 131-154, 156-165, 183-194, 225-237, 245-261, 264-271, 279-284, 287-297, 313-319, 327-336, 343-363, 380-386 and 11-197, 204-219, 258-372 of Seq ID No 173; 4-20, 34-41, 71-86, 100-110, 113-124, 133-143, 150-158, 160-166, 175-182, 191-197, 213-223, 233-239, 259-278, 298-322 and 195-289 of Seq ID No 174; 4-10, 21-35, 44-52, 54-62, 67-73, 87-103, 106-135, 161-174, 177-192, 200-209, 216-223, 249-298, 304-312, 315-329 and 12-130 of Seq ID No 175; 10-27, 33-38, 48-55, 70-76, 96-107, 119-133, 141-147, 151-165, 183-190, 197-210, 228-236, 245-250, 266-272, 289-295, 297-306, 308-315, 323-352, 357-371, 381-390, 394-401, 404-415, 417-425, 427-462, 466-483, 485-496, 502-507, 520-529, 531-541, 553-570, 577-588, 591-596, 600-610, 619-632, 642-665, 671-692, 694-707 and 434-444 of Seq ID No 176; 6-14, 16-25, 36-46, 52-70, 83-111, 129-138, 140-149, 153-166, 169-181, 188-206, 212-220, 223-259, 261-269, 274-282, 286-293, 297-306, 313-319, 329-341, 343-359, 377-390, 409-415, 425-430 and 360-375 of Seq ID No 177; 4-26, 28-48, 54-62, 88-121, 147-162, 164-201, 203-237, 245-251 and 254-260 of Seq ID No 178; 12-21, 26-32, 66-72, 87-93, 98-112, 125-149, 179-203, 209-226, 233-242, 249-261, 266-271, 273-289, 293-318, 346-354, 360-371, 391-400 and 369-382 of Seq ID No 179; 11-38, 44-65, 70-87, 129-135, 140-163, 171-177, 225-232, 238-249, 258-266, 271-280, 284-291, 295-300, 329-337, 344-352, 405-412, 416-424, 426-434, 436-455, 462-475, 478-487 and 270-312 of Seq ID No 180; 5-17, 34-45, 59-69, 82-88, 117-129, 137-142, 158-165, 180-195, 201-206, 219-226, 241-260, 269-279, 292-305, 312-321, 341-347, 362-381, 396-410, 413-432, 434-445, 447-453, 482-487, 492-499, 507-516, 546-552, 556-565, 587-604 and 486-598 of Seq ID No 181; 4-15, 17-32, 40-47, 67-78, 90-98, 101-107, 111-136, 161-171, 184-198, 208-214, 234-245, 247-254, 272-279, 288-298, 303-310, 315-320, 327-333, 338-349, 364-374 and 378-396 of Seq ID No 182; 5-27, 33-49, 51-57, 74-81, 95-107, 130-137, 148-157, 173-184 and 75-235 of Seq ID No 183; 6-23, 47-53, 57-63, 75-82, 97-105, 113-122, 124-134, 142-153, 159-164, 169-179, 181-187, 192-208, 215-243, 247-257, 285-290, 303-310 and 30-51 of Seq ID No 184; 17-29, 44-52, 59-73, 77-83, 86-92, 97-110, 118-153, 156-166, 173-179, 192-209, 225-231, 234-240, 245-251, 260-268, 274-279, 297-306, 328-340, 353-360, 369-382, 384-397, 414-423, 431-436, 452-465, 492-498, 500-508, 516-552, 554-560, 568-574, 580-586, 609-617, 620-626, 641-647 and 208-219 of Seq ID No 185; 4-26, 32-45, 58-72, 111-119, 137-143, 146-159, 187-193, 221-231, 235-242, 250-273, 290-304, 311-321, 326-339, 341-347, 354-368, 397-403, 412-419, 426-432, 487-506, 580-592, 619-628, 663-685, 707-716, 743-751, 770-776, 787-792, 850-859, 866-873, 882-888, 922-931, 957-963, 975-981, 983-989, 1000-1008, 1023-1029, 1058-1064, 1089-1099, 1107-1114, 1139-1145, 1147-1156, 1217-1226, 1276-1281, 1329-1335, 1355-1366, 1382-1394, 1410-1416, 1418-1424, 1443-1451, 1461-1469, 1483-1489, 1491-1501, 1515-1522, 1538-1544, 1549-1561, 1587-1593, 1603-1613, 1625-1630, 1636-1641, 1684-1690, 1706-1723, 1765-1771, 1787-1804, 1850-1857, 1863-1894, 1897-1910, 1926-1935, 1937-1943, 1960-1983, 1991-2005, 2008-2014, 2018-2039 and 396-533, 1342-1502, 1672-1920 of Seq ID No 186; 4-25, 45-50, 53-65, 79-85, 87-92, 99-109, 126-137, 141-148, 156-183, 190-203, 212-217, 221-228, 235-242, 247-277, 287-293, 300-319, 321-330, 341-361, 378-389, 394-406, 437-449, 455-461, 472-478, 482-491, 507-522, 544-554, 576-582, 587-593, 611-621, 626-632, 649-661, 679-685, 696-704, 706-716, 726-736, 740-751, 759-766, 786-792, 797-802, 810-822, 824-832, 843-852, 863-869, 874-879, 882-905 and 1-113, 210-232, 250-423, 536-564 of Seq ID No 187; 4-16, 33-39, 43-49, 54-85, 107-123, 131-147, 157-169, 177-187, 198-209, 220-230, 238-248, 277-286, 293-301, 303-315, 319-379, 383-393, 402-414, 426-432, 439-449, 470-478, 483-497, 502-535, 552-566, 571-582, 596-601, 608-620, 631-643, 651-656, 663-678, 680-699, 705-717, 724-732, 738-748, 756-763, 766-772, 776-791, 796-810, 819-827, 829-841, 847-861, 866-871, 876-882, 887-894, 909-934, 941-947, 957-969, 986-994, 998-1028, 1033-1070, 1073-1080, 1090-1096, 1098-1132, 1134-1159, 1164-1172, 1174-1201 and 617-635 of Seq ID No 188; 7-25, 30-40, 42-64, 70-77, 85-118, 120-166, 169-199, 202-213, 222-244 and 190-203 of Seq ID No 189; 4-11, 15-53, 55-93, 95-113, 120-159, 164-200, 210-243, 250-258, 261-283, 298-319, 327-340, 356-366, 369-376, 380-386, 394-406, 409-421, 425-435, 442-454, 461-472, 480-490, 494-505, 507-514, 521-527, 533-544, 566-574 and 385-398 of Seq ID No 190; 5-36, 66-72, 120-127, 146-152, 159-168, 172-184, 205-210, 221-232, 234-243, 251-275, 295-305, 325-332, 367-373, 470-479, 482-487, 520-548, 592-600, 605-615, 627-642, 655-662, 664-698, 718-725, 734-763, 776-784, 798-809, 811-842, 845-852, 867-872, 879-888, 900-928, 933-940, 972-977, 982-1003 and 12-190, 276-283, 666-806 of Seq ID No 191; 4-38, 63-68, 100-114, 160-173, 183-192, 195-210, 212-219, 221-238, 240-256, 258-266, 274-290, 301-311, 313-319, 332-341, 357-363, 395-401, 405-410, 420-426, 435-450, 453-461, 468-475, 491-498, 510-518, 529-537, 545-552, 585-592, 602-611, 634-639, 650-664 and 30-80, 89-105, 111-151 of Seq ID No 192; 7-29, 31-39, 47-54, 63-74, 81-94, 97-117, 122-127, 146-157, 168-192, 195-204, 216-240, 251-259 and 195-203 of Seq ID No 193; 5-16, 28-34, 46-65, 79-94, 98-105, 107-113, 120-134, 147-158, 163-172, 180-186, 226-233, 237-251, 253-259, 275-285, 287-294, 302-308, 315-321, 334-344, 360-371, 399-412, 420-426 and 32-50 of Seq ID No 194; 8-20, 30-36, 71-79, 90-96, 106-117, 125-138, 141-147, 166-174 and 75-90 of Seq ID No 195; 4-13, 15-33, 43-52, 63-85, 98-114, 131-139, 146-174, 186-192, 198-206, 227-233 and 69-88 of Seq ID No 196; 4-22, 29-35, 59-68, 153-170, 213-219, 224-238, 240-246, 263-270, 285-292, 301-321, 327-346, 356-371, 389-405, 411-418, 421-427, 430-437, 450-467, 472-477, 482-487, 513-518, 531-538, 569-576, 606-614, 637-657, 662-667, 673-690, 743-753, 760-767, 770-777, 786-802 and 96-230, 361-491, 572-585 of Seq ID No 197; 4-12, 21-36, 48-55, 74-82, 121-127, 195-203, 207-228, 247-262, 269-278, 280-289 and 102-210 of Seq ID No 198; 13-20, 23-31, 38-44, 78-107, 110-118, 122-144, 151-164, 176-182, 190-198, 209-216, 219-243, 251-256, 289-304, 306-313 and 240-248 of Seq ID No 199; 5-26, 34-48, 57-77, 84-102, 116-132, 139-145, 150-162, 165-173, 176-187, 192-205, 216-221, 234-248, 250-260 and 182-198 of Seq ID No 200; 10-19, 26-44, 53-62, 69-87, 90-96, 121-127, 141-146, 148-158, 175-193, 204-259, 307-313, 334-348, 360-365, 370-401, 411-439, 441-450, 455-462, 467-472, 488-504 and 41-56 of Seq ID No 201; 5-21, 36-42, 96-116, 123-130, 138-144, 146-157, 184-201, 213-228, 252-259, 277-297, 308-313, 318-323, 327-333 and 202-217 of Seq ID No 202; 6-26, 33-51, 72-90, 97-131, 147-154, 164-171, 187-216, 231-236, 260-269, 275-283 and 1-127 of Seq ID No 203; 4-22, 24-38, 44-58, 72-88, 99-108, 110-117, 123-129, 131-137, 142-147, 167-178, 181-190, 206-214, 217-223, 271-282, 290-305, 320-327, 329-336, 343-352, 354-364, 396-402, 425-434, 451-456, 471-477, 485-491, 515-541, 544-583, 595-609, 611-626, 644-656, 660-681, 683-691, 695-718 and 297-458 of Seq ID No 204; 5-43, 92-102, 107-116, 120-130, 137-144, 155-163, 169-174, 193-213 and 24-135 of Seq ID No 205; 4-25, 61-69, 73-85, 88-95, 97-109, 111-130, 135-147, 150-157, 159-179, 182-201, 206-212, 224-248, 253-260, 287-295, 314-331, 338-344, 365-376, 396-405, 413-422, 424-430, 432-449, 478-485, 487-494, 503-517, 522-536, 544-560, 564-578, 585-590, 597-613, 615-623, 629-636, 640-649, 662-671, 713-721 and 176-330 of Seq ID No 206; 31-37, 41-52, 58-79, 82-105, 133-179, 184-193, 199-205, 209-226, 256-277, 281-295, 297-314, 322-328, 331-337, 359-367, 379-395, 403-409, 417-432, 442-447, 451-460, 466-472 and 46-62, 296-341 of Seq ID No 207; 23-29, 56-63; 67-74, 96-108, 122-132, 139-146, 152-159, 167-178, 189-196, 214-231, 247-265, 274-293, 301-309, 326-332, 356-363, 378-395, 406-412, 436-442, 445-451, 465-479, 487-501, 528-555, 567-581, 583-599, 610-617, 622-629, 638-662, 681-686, 694-700, 711-716 and 667-684 of Seq ID No 208; 20-51, 53-59, 109-115, 140-154, 185-191, 201-209, 212-218, 234-243, 253-263, 277-290, 303-313, 330-337, 342-349, 374-382, 394-410, 436-442, 464-477, 486-499, 521-530, 536-550, 560-566, 569-583, 652-672, 680-686, 698-704, 718-746, 758-770, 774-788, 802-827, 835-842, 861-869 and 258-416 of Seq ID No 209; 7-25, 39-45, 59-70, 92-108, 116-127, 161-168, 202-211, 217-227, 229-239, 254-262, 271-278, 291-300 and 278-295 of Seq ID No 210; 4-20, 27-33, 45-51, 53-62, 66-74, 81-88, 98-111, 124-130, 136-144, 156-179, 183-191 and 183-195 of Seq ID No 211; 12-24, 27-33, 43-49, 55-71, 77-85, 122-131, 168-177, 179-203, 209-214, 226-241 and 63-238 of Seq ID No 212; 4-19, 37-50, 120-126, 131-137, 139-162, 177-195, 200-209, 211-218, 233-256, 260-268, 271-283, 288-308 and 1-141 of Seq ID No 213; 11-17, 40-47, 57-63, 96-124, 141-162, 170-207, 223-235, 241-265, 271-277, 281-300, 312-318, 327-333, 373-379 and 231-368 of Seq ID No 214; 9-33, 41-48, 57-79, 97-103, 113-138, 146-157, 165-186, 195-201, 209-215, 223-229, 237-247, 277-286, 290-297, 328-342 and 247-260 of Seq ID No 215; 7-15, 39-45, 58-64, 79-84, 97-127, 130-141, 163-176, 195-203, 216-225, 235-247, 254-264, 271-279 and 64-72 of Seq ID No 216; 4-12, 26-42, 46-65, 73-80, 82-94, 116-125, 135-146, 167-173, 183-190, 232-271, 274-282, 300-306, 320-343, 351-362, 373-383, 385-391, 402-409, 414-426, 434-455, 460-466, 473-481, 485-503, 519-525, 533-542, 554-565, 599-624, 645-651, 675-693, 717-725, 751-758, 767-785, 792-797, 801-809, 819-825, 831-836, 859-869, 890-897 and 222-362, 756-896 of Seq ID No 217; 11-17, 22-28, 52-69, 73-83, 86-97, 123-148, 150-164, 166-177, 179-186, 188-199, 219-225, 229-243, 250-255 and 153-170 of Seq ID No 218; 4-61, 71-80, 83-90, 92-128, 133-153, 167-182, 184-192, 198-212 and 56-73 of Seq ID No 219; 4-19, 26-37, 45-52, 58-66, 71-77, 84-92, 94-101, 107-118, 120-133, 156-168, 170-179, 208-216, 228-238, 253-273, 280-296, 303-317, 326-334 and 298-312 of Seq ID No 220; 7-13, 27-35, 38-56, 85-108, 113-121, 123-160, 163-169, 172-183, 188-200, 206-211, 219-238, 247-254 and 141-157 of Seq ID No 221; 23-39, 45-73, 86-103, 107-115, 125-132, 137-146, 148-158, 160-168, 172-179, 185-192, 200-207, 210-224, 233-239, 246-255, 285-334, 338-352, 355-379, 383-389, 408-417, 423-429, 446-456, 460-473, 478-503, 522-540, 553-562, 568-577, 596-602, 620-636, 640-649, 655-663 and 433-440, 572-593 of Seq ID No 222; 4-42, 46-58, 64-76, 118-124, 130-137, 148-156, 164-169, 175-182, 187-194, 203-218, 220-227, 241-246, 254-259, 264-270, 275-289, 296-305, 309-314, 322-334, 342-354, 398-405, 419-426, 432-443, 462-475, 522-530, 552-567, 593-607, 618-634, 636-647, 653-658, 662-670, 681-695, 698-707, 709-720, 732-742, 767-792, 794-822, 828-842, 851-866, 881-890, 895-903, 928-934, 940-963, 978-986, 1003-1025, 1027-1043, 1058-1075, 1080-1087, 1095-1109, 1116-1122, 1133-1138, 1168-1174, 1179-1186, 1207-1214, 1248-1267 and 17-319, 417-563 of Seq ID No 223; 6-19, 23-33, 129-138, 140-150, 153-184, 190-198, 206-219, 235-245, 267-275, 284-289, 303-310, 322-328, 354-404, 407-413, 423-446, 453-462, 467-481, 491-500 and 46-187 of Seq ID No 224; 4-34, 39-57, 78-86, 106-116, 141-151, 156-162, 165-172, 213-237, 252-260, 262-268, 272-279, 296-307, 332-338, 397-403, 406-416, 431-446, 448-453, 464-470, 503-515, 519-525, 534-540, 551-563, 578-593, 646-668, 693-699, 703-719, 738-744, 748-759, 771-777, 807-813, 840-847, 870-876, 897-903, 910-925, 967-976, 979-992 and 21-244, 381-499, 818-959 of Seq ID No 225; 19-29, 65-75, 90-109, 111-137, 155-165, 169-175 and 118-136 of Seq ID No 226; 15-20, 30-36, 55-63, 73-79, 90-117, 120-127, 136-149, 166-188, 195-203, 211-223, 242-255, 264-269, 281-287, 325-330, 334-341, 348-366, 395-408, 423-429, 436-444, 452-465 and 147-155 of Seq ID No 227; 11-18, 21-53, 77-83, 91-98, 109-119, 142-163, 173-181, 193-208, 216-227, 238-255, 261-268, 274-286, 290-297, 308-315, 326-332, 352-359, 377-395, 399-406, 418-426, 428-438, 442-448, 458-465, 473-482, 488-499, 514-524, 543-533, 564-600, 623-632, 647-654, 660-669, 672-678, 710-723, 739-749, 787-793, 820-828, 838-860, 889-895, 901-907, 924-939, 956-962, 969-976, 991-999, 1012-1018, 1024-1029, 1035-1072, 1078-1091, 1142-1161 and 74-438 of Seq ID No 228; 4-31, 41-52, 58-63, 65-73, 83-88, 102-117, 123-130, 150-172, 177-195, 207-217, 222-235, 247-253, 295-305, 315-328, 335-342, 359-365, 389-394, 404-413 and 156-420 of Seq ID No 229; 4-42, 56-69, 98-108, 120-125, 210-216, 225-231, 276-285, 304-310, 313-318, 322-343 and 79-348 of Seq ID No 230; 12-21, 24-30, 42-50, 61-67, 69-85, 90-97, 110-143, 155-168 and 53-70 of Seq ID No 231; 4-26, 41-54, 71-78, 88-96, 116-127, 140-149, 151-158, 161-175, 190-196, 201-208, 220-226, 240-247, 266-281, 298-305, 308-318, 321-329, 344-353, 370-378, 384-405, 418-426, 429-442, 457-463, 494-505, 514-522 and 183-341 of Seq ID No 232; 4-27, 69-77, 79-101, 117-123, 126-142, 155-161, 171-186, 200-206, 213-231, 233-244, 256-263, 269-275, 315-331, 337-346, 349-372, 376-381, 401-410, 424-445, 447-455, 463-470, 478-484, 520-536, 546-555, 558-569, 580-597, 603-618, 628-638, 648-660, 668-683, 717-723, 765-771, 781-788, 792-806, 812-822 and 92-231, 618-757 of Seq ID No 233; 11-47, 63-75, 108-117, 119-128, 133-143, 171-185, 190-196, 226-232, 257-264, 278-283, 297-309, 332-338, 341-346, 351-358, 362-372 and 41-170 of Seq ID No 234; 6-26, 50-56, 83-89, 108-114, 123-131, 172-181, 194-200, 221-238, 241-259, 263-271, 284-292, 304-319, 321-335, 353-358, 384-391, 408-417, 424-430, 442-448, 459-466, 487-500, 514-528, 541-556, 572-578, 595-601, 605-613, 620-631, 634-648, 660-679, 686-693, 702-708, 716-725, 730-735, 749-755, 770-777, 805-811, 831-837, 843-851, 854-860, 863-869, 895-901, 904-914, 922-929, 933-938, 947-952, 956-963, 1000-1005, 1008-1014, 1021-1030, 1131-1137, 1154-1164, 1166-1174 and 20-487, 757-1153 of Seq ID No 235; 10-34, 67-78, 131-146, 160-175, 189-194, 201-214, 239-250, 265-271, 296-305 and 26-74, 91-100, 105-303 of Seq ID No 236; 9-15, 19-32, 109-122, 143-150, 171-180, 186-191, 209-217, 223-229, 260-273, 302-315, 340-346, 353-359, 377-383, 389-406, 420-426, 460-480 and 10-223, 231-251, 264-297, 312-336 of Seq ID No 237; 5-28, 76-81, 180-195, 203-209, 211-219, 227-234, 242-252, 271-282, 317-325, 350-356, 358-364, 394-400, 405-413, 417-424, 430-436, 443-449, 462-482, 488-498, 503-509, 525-537 and 22-344 of Seq ID No 238; 5-28, 42-54, 77-83, 86-93, 98-104, 120-127, 145-159, 166-176, 181-187, 189-197, 213-218, 230-237, 263-271, 285-291, 299-305, 326-346, 368-375, 390-395 and 1-151 of Seq ID No 239; 6-34, 48-55, 58-64, 84-101, 121-127, 143-149, 153-159, 163-170, 173-181, 216-225, 227-240, 248-254, 275-290, 349-364, 375-410, 412-418, 432-438, 445-451, 465-475, 488-496, 505-515, 558-564, 571-579, 585-595, 604-613, 626-643, 652-659, 677-686, 688-696, 702-709, 731-747, 777-795, 820-828, 836-842, 845-856, 863-868, 874-882, 900-909, 926-943, 961-976, 980-986, 992-998, 1022-1034, 1044-1074, 1085-1096, 1101-1112, 1117-1123, 1130-1147, 1181-1187, 1204-1211, 1213-1223, 1226-1239, 1242-1249, 1265-1271, 1273-1293, 1300-1308, 1361-1367, 1378-1384, 1395-1406, 1420-1428, 1439-1446, 1454-1460, 1477-1487, 1509-1520, 1526-1536, 1557-1574, 1585-1596, 1605-1617, 1621-1627, 1631-1637, 1648-1654, 1675-1689, 1692-1698, 1700-1706, 1712-1719, 1743-1756 and 91-263 of Seq ID No 240; 4-16, 75-90, 101-136, 138-144, 158-164, 171-177, 191-201, 214-222, 231-241, 284-290, 297-305, 311-321, 330-339, 352-369, 378-385, 403-412, 414-422, 428-435, 457-473, 503-521, 546-554, 562-568, 571-582, 589-594, 600-608, 626-635, 652-669, 687-702, 706-712, 718-724, 748-760, 770-775 and 261-272 of Seq ID No 241; 4-19, 30-41, 46-57, 62-68, 75-92, 126-132, 149-156, 158-168, 171-184, 187-194, 210-216, 218-238, 245-253, 306-312, 323-329, 340-351, 365-373, 384-391, 399-405, 422-432, 454-465, 471-481, 502-519, 530-541, 550-562, 566-572, 576-582, 593-599, 620-634, 637-643, 645-651, 657-664, 688-701 and 541-551 of Seq ID No 242; 6-11, 17-25, 53-58, 80-86, 91-99, 101-113, 123-131, 162-169, 181-188, 199-231, 245-252 and 84-254 of Seq ID No 243; 13-30, 71-120, 125-137, 139-145, 184-199 and 61-78 of Seq ID No 244; 9-30, 38-53, 63-70, 74-97, 103-150, 158-175, 183-217, 225-253, 260-268, 272-286, 290-341, 352-428, 434-450, 453-460, 469-478, 513-525, 527-534, 554-563, 586-600, 602-610, 624-640, 656-684, 707-729, 735-749, 757-763, 766-772, 779-788, 799-805, 807-815, 819-826, 831-855 and 568-580 of Seq ID No 245; 11-21, 29-38 and 5-17 of Seq ID No 246; 2-9 of Seq ID No 247; 4-10, 16-28 and 7-18, 26-34 of Seq ID No 248; 10-16 and 1-15 of Seq ID No 249; 4-11 of Seq ID No 250; 4-40, 42-51 and 37-53 of Seq ID No 251; 4-21 and 22-29 of Seq ID No 252; 2-11 Seq ID No 253; 9-17, 32-44 and 1-22 of Seq ID No 254; 19-25, 27-32 and 15-34 of Seq ID No 255; 4-12, 15-22 and 11-33 of Seq ID No 256; 10-17, 24-30, 39-46, 51-70 and 51-61 of Seq ID No 257; 6-19 of Seq ID No 258; 6-11, 21-27, 31-54 and 11-29 of Seq ID No 259; 4-10, 13-45 and 11-35 of Seq ID No 260; 4-14, 23-32 and 11-35 of Seq ID No 261; 14-39, 45-51 and 15-29 of Seq ID No 262; 4-11, 14-28 and 4-17 of Seq ID No 263; 4-16 and 2-16 and 2-16 of Seq ID No 264; 4-10, 12-19, 39-50 and 6-22 of Seq ID No 265; 2-13 of Seq ID No 266; 4-11, 22-65 and 3-19 of Seq ID No 267; 17-23, 30-35, 39-46, 57-62 and 30-49 of Seq ID No 268; 4-19 and 14-22 of Seq ID No 269; 2-9 of Seq ID No 270; 7-18, 30-43 and 4-12 of Seq ID No 271; 4-30, 39-47 and 5-22 of Seq ID No 272; 6-15 and 14-29 of Seq ID No 273; 4-34 and 23-35 of Seq ID No 274; 4-36, 44-57, 65-72 and 14-27 of Seq ID No 275; 4-18 and 11-20 of Seq ID No 276; 5-19 of Seq ID No 277; 18-36 and 6-20 of Seq ID No 278; 4-10, 19-34, 41-84, 96-104 and 50-63 of Seq ID No 279; 4-9, 19-27 and 8-21 of Seq ID No 280; 4-16, 18-28 and 22-30 of Seq ID No 281; 4-15 and 21-35 of Seq ID No 282; 4-17 and 3-13 of Seq ID No 283; 4-12 and 4-18 of Seq ID No 284; 4-24, 31-36 and 29-45 of Seq ID No 285; 12-22, 34-49 and 21-32 of Seq ID No 286; 4-17 and 22-32 of Seq ID No 287; 4-16, 25-42 and 7-28 of Seq ID No 288; 4-10 and 7-20 of Seq ID No 289; 4-11, 16-36, 39-54 and 28-44 of Seq ID No 290; 5-20, 29-54 and 14-29 of Seq ID No 291; 24-33 and 10-22 of Seq ID No 292 10-51, 54-61 and 43-64 of Seq ID No 293; 7-13 and 2-17 of Seq ID No 294; 11-20 and 6-20 of Seq ID No 295; 4-30, 34-41 and 19-28 of Seq ID No 296; 11-21 of Seq ID No 297; 4-16, 21-26 and 9-38 of Seq ID No 298; 4-12, 15-27, 30-42, 66-72 and 10-24 of Seq ID No 299; 8-17 and 11-20 of Seq ID No 300; and 2-19 of Seq ID No 246; 1-12 of Seq ID No 247; 21-38 of Seq ID No 248; 2-22 of Seq ID No 254; 15-33 of Seq ID No 255; 11-32 of Seq ID No 256; 11-28 of Seq ID No 259; 10-27 of Seq ID No 260; 9-26 of Seq ID No 261; 4-16 of Seq ID No 263; 1-18 of Seq ID No 266; 12-29 of Seq ID No 273; 6-23 of Seq ID No 276; 1-21 of Seq ID No 277; 47-64 of Seq ID No 279; 28-45 of Seq ID No 285; 18-35 of Seq ID No 287; 14-31 of Seq ID No 291; 7-24 of Seq ID No 292; 8-25 of Seq ID No 299; 1-20 of Seq ID No 300; 18-33 of Seq ID No 151; 62-72 of Seq ID No 151; 118-131 of Seq ID No 152; 195-220 of Seq ID No 154; 215-240 of Seq ID No 154; 255-280 of Seq ID No 154, 72-81 of Seq ID No 155; 174-186 of Seq ID No 156; 317-331 of Seq ID No 157; 35-59 of Seq ID No 158; 54-84 of Seq ID No 158; 79-104 of Seq ID No 158; 33-58 of Seq ID No 159; 81-101 of Seq ID No 159; 136-150 of Seq ID No 159; 173-186 of Seq ID No 159; 231-251 of Seq ID No 159; 22-48 of Seq ID No 161; 24-39 of Seq ID No 162; 475-489 of Seq ID No 163; 38-56 of Seq ID No 164; 583-604 of Seq ID No 164; 202-223 of Seq ID No 165; 222-247 of Seq ID No 165; 242-267 of Seq ID No 165; 262-287 of Seq ID No 165; 282-307 of Seq ID No 165; 302-327 of Seq ID No 165; 25-48 of Seq ID No 166; 204-217 of Seq ID No 167; 259-276 of Seq ID No 168; 121-139 of Seq ID No 169; 260-267 of Seq ID No 169; 215-240 of Seq ID No 169; 115-140 of Seq ID No 170; 182-204 of Seq ID No 172; 144-153 of Seq ID No 173; 205-219 of Seq ID No 173; 196-206 of Seq ID No 174; 240-249 of Seq ID No 174; 272-287 of Seq ID No 174; 199-223 of Seq ID No 174; 218-237 of Seq ID No 174; 226-249 of Seq ID No 175; 287-306 of Seq ID No 175; 430-449 of Seq ID No 176; 361-375 of Seq ID No 177; 241-260 of Seq ID No 178; 483-502 of Seq ID No 181; 379-396 of Seq ID No 182; 31-51 of Seq ID No 184; 1436-1460 of Seq ID No 186; 1455-1474 of Seq ID No 186; 1469-1487 of Seq ID No 186; 215-229 of Seq ID No 187; 534-561 of Seq ID No 187; 59-84 of Seq ID No 187; 79-104 of Seq ID No 187; 618-635 of Seq ID No 188; 191-203 of Seq ID No 189; 386-398 of Seq ID No 190; 65-83 of Seq ID No 191; 90-105 of Seq ID No 192; 112-136 of Seq ID No 192; 290-209 of Seq ID No 193; 33-50 of Seq ID No 194; 76-90 of Seq ID No 195; 70-88 of Seq ID No 196; 418-442 of Seq ID No 197; 574-585 of Seq ID No 197; 87-104 of Seq ID No 198; 124-148 of Seq ID No 198; 141-152 of Seq ID No 198; 241-248 of Seq ID No 199; 183-198 of Seq ID No 200; 40-57 of Seq ID No 201; 202-217 of Seq ID No 202; 50-74 of Seq ID No 203; 69-93 of Seq ID No 203; 88-112 of Seq ID No 203; 107-127 of Seq ID No 203; 74-92 of Seq ID No 205; 207-232 of Seq ID No 206; 227-252 of Seq ID No 206; 247-272 of Seq ID No 206; 47-60 of Seq ID No 207; 297-305 of Seq ID No 207; 312-337 of Seq ID No 207; 667-384 of Seq ID No 208; 279-295 of Seq ID No 210; 179-198 of Seq ID No 211; 27-51 of Seq ID No 213; 46-70 of Seq ID No 213; 65-89 of Seq ID No 213; 84-108 of Seq ID No 213; 112-141 of Seq ID No 213; 248-260 of Seq ID No 215; 59-78 of Seq ID No 216; 154-170 of Seq ID No 218; 57-73 of Seq ID No 219; 297-314 of Seq ID No 220; 142-157 of Seq ID No 221; 428-447 of Seq ID No 222; 573-593 of Seq ID No 222; 523-544 of Seq ID No 223; 46-70 of Seq ID No 223; 65-89 of Seq ID No 223; 84-108 of Seq ID No 223; 122-151 of Seq ID No 223; 123-142 of Seq ID No 224; 903-921 of Seq ID No 225; 119-136 of Seq ID No 226; 142-161 of Seq ID No 227; 258-277 of Seq ID No 228; 272-300 of Seq ID No 228; 295-322 of Seq ID No 228; 311-343 of Seq ID No 229; 278-304 of Seq ID No 229; 131-150 of Seq ID No 230; 195-218 of Seq ID No 230; 53-70 of Seq ID No 231; 184-208 of Seq ID No 232; 222-246 of Seq ID No 232; 241-265 of Seq ID No 232; 260-284 of Seq ID No 232; 279-303 of Seq ID No 232; 317-341 of Seq ID No 232; 678-696 of Seq ID No 233; 88-114 of Seq ID No 235; 464-481 of Seq ID No 235; 153-172 of Seq ID No 236; 137-155, 166-184 of Seq ID No 236; 215-228 of Seq ID No 236; 37-51 of Seq ID No 237; 53-75 of Seq ID No 237; 232-251 of Seq ID No 237; 318-336 of Seq ID No 237; 305-315 of Seq ID No 238; 131-156 of Seq ID No 238; 258-275 of Seq ID No 241; 107-137 of Seq ID No 243; 138-162 of Seq ID No 243; 157-181 of Seq ID No 243; 195-227 of Seq ID No 243; 62-78 of Seq ID No 244; 567-584 of Seq ID No 245.

The present invention also provides a process for producing a S. pyogenes hyperimmune serum reactive antigen or a fragment thereof according to the present invention comprising expressing one or more of the nucleic acid molecules according to the present invention in a suitable expression system.

Moreover, the present invention provides a process for producing a cell, which expresses a S. pyogenes hyperimmune serum reactive antigen or a fragment thereof according to the present invention comprising transforming or transfecting a suitable host cell with the vector according to the present invention.

According to the present invention a pharmaceutical composition, especially a vaccine, comprising a hyperimmune serum-reactive antigen or a fragment thereof as defined in the present invention or a nucleic add molecule as defined in the present invention is provided.

In a preferred embodiment the pharmaceutical composition further comprises an immunostimulatory substance, preferably selected from the group comprising polycationic polymers, especially polycationic peptides, immunostimulatory deoxynucleotides (ODNs), peptides containing at least two LysLeuLys motifs, especially KLKL5KLK, neuroactive compounds, especially human growth hormone, alumn, Freund's complete or incomplete adjuvants or combinations thereof.

In a more preferred embodiment the immunostimulatory substance is a combination of either a polycationic polymer and immunostimulatory deoxynucleotides or of a peptide containing at least two LysLeuLys motifs and immunostimulatory deoxynucleotides.

In a still more preferred embodiment the polycationic polymer is a polycationic peptide, especially polyarginine.

According to the present invention the use of a nucleic acid molecule according to the present invention or a hyperimmune serum-reactive antigen or fragment thereof according to the present invention for the manufacture of a pharmaceutical preparation, especially for the manufacture of a vaccine against S. pyogenes infection, is provided.

Also an antibody, or at least an effective part thereof, which binds at least to a selective part of the hyperimmune serum-reactive antigen or a fragment thereof according to the present invention is provided herewith.

In a preferred embodiment the antibody is a monoclonal antibody.

In another preferred embodiment the effective part of the antibody comprises Fab fragments.

In a further preferred embodiment the antibody is a chimeric antibody.

In a still preferred embodiment the antibody is a humanized antibody.

The present invention also provides a hybridoma cell line, which produces an antibody according to the present invention.

Moreover, the present invention provides a method for producing an antibody according to the present invention, characterized by the following steps:
  initiating an immune response in a non-human animal by administrating an hyperimmune serum-reactive antigen or a fragment thereof, as defined in the invention, to said animal,
  removing an antibody containing body fluid from said animal, and
  producing the antibody by subjecting said antibody containing body fluid to further purification steps.

Accordingly, the present invention also provides a method for producing an antibody according to the present invention, characterized by the following steps:
  initiating an immune response in a non-human animal by administrating an hyperimmune serum-reactive antigen or a fragment thereof, as defined in the present invention, to said animal,
  removing the spleen or spleen cells from said animal,
  producing hybridoma cells of said spleen or spleen cells,
  selecting and cloning hybridoma cells specific for said hyperimmune serum-reactive antigens or a fragment thereof,
  producing the antibody by cultivation of said cloned hybridoma cells and optionally further purification steps.

The antibodies provided or produced according to the above methods may be used for the preparation of a medicament for treating or preventing S. pyogenes infections.

According to another aspect the present invention provides an antagonist which binds to a hyperimmune serum-reactive antigen or a fragment thereof according to the present invention.

Such an antagonist capable of binding to a hyperimmune serum-reactive antigen or fragment thereof according to the present invention may be identified by a method comprising the following steps:
  a) contacting an isolated or immobilized hyperimmune serum-reactive antigen or a fragment thereof according to the present invention with a candidate antagonist under conditions to permit binding of said candidate antagonist to said hyperimmune serum-reactive antigen or fragment, in the presence of a component capable of providing a detectable signal in response to the binding of the candidate antagonist to said hyperimmune serum reactive antigen or fragment thereof; and
  b) detecting the presence or absence of a signal generated in response to the binding of the antagonist to the hyperimmune serum reactive antigen or the fragment thereof.

An antagonist capable of reducing or inhibiting the interaction activity of a hyperimmune serum-reactive antigen or a fragment thereof according to the present invention to its interaction partner may be identified by a method comprising the following steps:
  a) providing a hyperimmune serum reactive antigen or a hyperimmune fragment thereof according to the present invention,
  b) providing an interaction partner to said hyperimmune serum reactive antigen or a fragment thereof, especially an antibody according to the present invention,
  c) allowing interaction of said hyperimmune serum reactive antigen or fragment thereof to said interaction partner to form a interaction complex,
  d) providing a candidate antagonist,
  e) allowing a competition reaction to occur between the candidate antagonist and the interaction complex,
  f) determining whether the candidate antagonist inhibits or reduces the interaction activities of the hyperimmune serum reactive antigen or the fragment thereof with the interaction partner.

The hyperimmune serum reactive antigens or fragments thereof according to the present invention may be used for the isolation and/or purification and/or identification of an interaction partner of said hyperimmune serum reactive antigen or fragment thereof.

The present invention also provides a process for in vitro diagnosing a disease related to expression of a hyperimmune serum-reactive antigen or a fragment thereof according to the present invention comprising determining the presence of a nucleic acid sequence encoding said hyperimmune serum reactive antigen and fragment according to the present invention or the presence of the hyperimmune serum reactive antigen or fragment thereof according to the present invention.

The present invention also provides a process for in vitro diagnosis of a bacterial infection, especially a S. pyogenes infection, comprising analyzing for the presence of a nucleic acid sequence encoding said hyperimmune serum reactive antigen and fragment according to the present invention or the presence of the hyperimmune serum reactive antigen or fragment thereof according to the present invention.

Moreover, the present invention provides the use of a hyperimmune serum reactive antigen or fragment thereof according to the present invention for the generation of a peptide binding to said hyperimmune serum reactive antigen or fragment thereof, wherein the peptide is an anticaline.

The present invention also provides the use of a hyperimmune serum-reactive antigen or fragment thereof according to the present invention for the manufacture of a functional nucleic acid, wherein the functional nucleic acid is selected from the group comprising aptamers and spiegelmers.

The nucleic acid molecule according to the present invention may also be used for the manufacture of a functional ribonucleic acid, wherein the functional ribonucleic acid is selected from the group comprising ribozymes, antisense nucleic acids and siRNA.

The present invention advantageously provides an efficient, relevant and comprehensive set of isolated nucleic acid molecules and their encoded hyperimmune serum reactive antigens and fragments thereof identified from *S. pyogenes* using an antibody preparation from multiple human plasma pools and surface expression libraries derived from the genome of *S. pyogenes*. Thus, the present invention fulfills a widely felt demand for *S. pyogenes* antigens, vaccines, diagnostics and products useful in procedures for preparing antibodies and for identifying compounds effective against *S. pyogenes* infection. An effective vaccine should be composed of proteins or polypeptides, which are expressed by all strains and are able to induce high affinity, abundant antibodies against cell surface components of *S. pyogenes*. The antibodies should be IgG1 and/or IgG3 for opsonization, and any IgG subtype and IgA for neutralisation of adherence and toxin action. A chemically defined vaccine must be definitely superior compared to a whole cell vaccine (attenuated or killed), since components of *S. pyogenes*, which cross-react with human tissues or inhibit opsonization {Whitnack, E. et al., 1985} can be eliminated, and the individual proteins inducing protective antibodies and/or a protective immune response can be selected.

The approach, which has been employed for the present invention, is based on the interaction of group A *streptococcal* proteins or peptides with the antibodies present in human sera. The antibodies produced against *S. pyogenes* by the human immune system and present in human sera are indicative of the in vivo expression of the antigenic proteins and their immunogenicity. In addition, the antigenic proteins as identified by the bacterial surface display expression libraries using pools of pre-selected sera, are processed in a second and third round of screening by individual selected or generated sera. Thus the present invention supplies an efficient, relevant, comprehensive set of group A *streptococcal* antigens as a pharmaceutical composition, especially a vaccine preventing infection by *S. pyogenes*.

In the antigen identification program for identifying a comprehensive set of antigens according to the present invention, at least two different bacterial surface expression libraries are screened with several serum pools or plasma fractions or other pooled antibody containing body fluids (antibody pools). The antibody pools are derived from a serum collection, which has been tested against antigenic compounds of *S. pyogenes*, such as whole cell extracts and culture supernatant proteins. Preferably, 2 distinct serum collections are used: 1. With very stable antibody repertoire: normal adults, clinically healthy people, who are non-carriers and overcame previous encounters or currently carriers of *S. pyogenes* without acute disease and symptoms, 2. With antibodies induced acutely by the presence of the pathogenic organism: patients with acute disease with different manifestations (e.g. *S. pyogenes* pharyngitis, wound infection and bacteraemia). Sera have to react with multiple group A *streptococci*-specific antigens in order to be considered hyperimmune and therefore relevant in the screening method applied for the present invention. The antibodies produced against *streptococci* by the human immune system and present in human sera are indicative of the in vivo expression of the antigenic proteins and their immunogenicity.

The expression libraries as used in the present invention should allow expression of all potential antigens, e.g. derived from all surface proteins of *S. pyogenes*. Bacterial surface display libraries will be represented by a recombinant library of a bacterial host displaying a (total) set of expressed peptide sequences of group A *streptococci* on a number of selected outer membrane proteins (LamB, BtuB, FhuA) at the bacterial host membrane {Georgiou, G., 1997; Etz, H. et al., 2001}.

One of the advantages of using recombinant expression libraries is that the identified hyperimmune serum-reactive antigens may be instantly produced by expression of the coding sequences of the screened and selected clones expressing the hyperimmune serum-reactive antigens without further recombinant DNA technology or cloning steps necessary.

The comprehensive set of antigens identified by the described program according to the present invention is analysed further by one or more additional rounds of screening. Therefore individual antibody preparations or antibodies generated against selected peptides which were identified as immunogenic are used. According to a preferred embodiment the individual antibody preparations for the second round of screening are derived from patients who have suffered from an acute infection with group A *streptococci*, especially from patients who show an antibody titer above a certain minimum level, for example an antibody titer being higher than 80 percentile, preferably higher than 90 percentile, especially higher than 95 percentile of the human (patient or healthy individual) sera tested. Using such high titer individual antibody preparations in the second screening round allows a very selective identification of the hyperimmune serum-reactive antigens and fragments thereof from *S. pyogenes*.

Following the high throughput screening procedure, the selected antigenic proteins, expressed as recombinant proteins or in vitro translated products, in case it can not be expressed in prokaryotic expression systems, or the identified antigenic peptides (produced synthetically) are tested in a second screening by a series of ELISA and Western blotting assays for the assessment of their immunogenicity with a large human serum collection (>100 uninfected, >50 patients sera).

It is important that the individual antibody preparations (which may also be the selected serum) allow a selective identification of the hyperimmune serum-reactive antigens from all the promising candidates from the first round. Therefore, preferably at least 10 individual antibody preparations (i.e. antibody preparations (e.g. sera) from at least 10 different individuals having suffered from an infection to the chosen pathogen) should be used in identifying these antigens in the second screening round. Of course, it is possible to use also less than 10 individual preparations, however, selectivity of the step may not be optimal with a low number of individual antibody preparations. On the other hand, if a given hyperimmune serum-reactive antigen (or an antigenic fragment thereof) is recognized by at least 10 individual antibody preparations, preferably at least 30, especially at least 50 individual antibody preparations, identification of the hyperimmune serum-reactive antigen is also selective enough for a proper identification. Hyperimmune serum-reactivity may of course be tested with as many individual preparations as possible (e.g. with more than 100 or even with more than 1,000).

Therefore, the relevant portion of the hyperimmune serum-reactive antibody preparations according to the method of the present invention should preferably be at least 10, more preferred at least 30, especially at least 50 individual antibody preparations. Alternatively (or in combination) hyperimmune serum-reactive antigens may preferably be also identified with at least 20%, preferably at least 30%, especially at least 40% of all individual antibody preparations used in the second screening round.

According to a preferred embodiment of the present invention, the sera from which the individual antibody preparations for the second round of screening are prepared (or which are used as antibody preparations), are selected by their titer against *S. pyogenes* (e.g. against a preparation of this pathogen, such as a lysate, cell wall components and recombinant proteins). Preferably, some are selected with a total IgA titer above 4,000 U, especially above 6,000 U, and/or an IgG titer above 10,000 U, especially above 12,000 U (U=units, calculated from the $OD_{405\,nm}$ reading at a given dilution) when the whole organism (total lysate or whole cells) is used as antigen in the ELISA.

The antibodies produced against *streptococci* by the human immune system and present in human sera are indicative of the in vivo expression of the antigenic proteins and their immunogenicity. The recognition of linear epitopes by antibodies can be based on sequences as short as 4-5 amino acids. Of course it does not necessarily mean that these short peptides are capable of inducing the given antibody in vivo. For that reason the defined epitopes, polypeptides and proteins are further to be tested in animals (mainly in mice) for their capacity to induce antibodies against the selected proteins in vivo.

The preferred antigens are located on the cell surface or secreted, and are therefore accessible extracellularly. Antibodies against cell wall proteins are expected to serve two purposes: to inhibit adhesion and to promote phagocytosis. Antibodies against secreted proteins are beneficial in neutralisation of their function as toxin or virulence component. It is also known that bacteria communicate with each other through secreted proteins. Neutralizing antibodies against these proteins will interrupt growth-promoting cross-talk between or within *streptococcal* species. Bioinformatic analyses (signal sequences, cell wall localisation signals, transmembrane domains) proved to be very useful in assessing cell surface localisation or secretion. The experimental approach includes the isolation of antibodies with the corresponding epitopes and proteins from human serum, and the generation of immune sera in mice against (poly)peptides selected by the bacterial surface display screens. These sera are then used in a third round of screening as reagents in the following assays: cell surface staining of group A *streptococci* grown under different conditions (FACS, microscopy), determination of neutralizing capacity (toxin, adherence), and promotion of opsonization and phagocytosis (in vitro phagocytosis assay).

For that purpose, bacterial *E. coli* clones are directly injected into mice and immune sera taken and tested in the relevant in vitro assay for functional opsonic or neutralizing antibodies. Alternatively, specific antibodies may be purified from human or mouse sera using peptides or proteins as substrate.

Host defence against *S. pyogenes* relies mainly on innate immunological mechanisms. Inducing high affinity antibodies of the opsonic and neutralizing type by vaccination helps the innate immune system to eliminate bacteria and toxins. This makes the method according to the present invention an optimal tool for the identification of group A *streptococcal* antigenic proteins.

The skin and mucous membranes are formidable barriers against invasion by *streptococci*. However, once the skin or the mucous membranes are breached the first line of non-adaptive cellular defence begins its co-ordinate action through complement and phagocytes, especially the polymorphonuclear leukocytes (PMNs). These cells can be regarded as the cornerstones in eliminating invading bacteria. As group A *streptococci* are primarily extracellular pathogens, the major anti-*streptococcal* adaptive response comes from the humoral arm of the immune system, and is mediated through three major mechanisms: promotion of opsonization, toxin neutralisation, and inhibition of adherence. It is believed that opsonization is especially important, because of its requirement for an effective phagocytosis. For efficient opsonization the microbial surface has to be coated with antibodies and complement factors for recognition by PMNs through receptors to the Fc fragment of the IgG molecule or to activated C3b. After opsonization, *streptococci* are phagocytosed and killed. Antibodies bound to specific antigens on the cell surface of bacteria serve as ligands for the attachment to PMNs and to promote phagocytosis. The very same antibodies bound to the adhesins and other cell surface proteins are expected to neutralize adhesion and prevent colonization. The selection of antigens as provided by the present invention is thus well suited to identify those that will lead to protection against infection in an animal model or in humans.

According to the antigen identification method used herein, the present invention can surprisingly provide a set of comprehensive novel nucleic acids and novel hyperimmune serum reactive antigens and fragments thereof of *S. pyogenes*, among other things, as described below. According to one aspect, the invention particularly relates to the nucleotide sequences encoding hyperimmune serum reactive antigens which sequences are set forth in the Sequence listing Seq ID No: 1-150 and the corresponding encoded amino acid sequences representing hyperimmune serum reactive antigens are set forth in the Sequence Listing Seq ID No 151-300.

In a preferred embodiment of the present invention, a nucleic acid molecule is provided which exhibit 70% identity over their entire length to a nucleotide sequence set forth with Seq ID No 1, 48, 10-18, 20, 22, 24-32, 34-35, 38-40, 43-46, 49-51, 53-54, 57-61, 63, 65-71, 73, 75-77, 81-82, 88, 91-94 and 96-150. Most highly preferred are nucleic acids that comprise a region that is at least 80% or at least 85% identical over their entire length to a nucleic acid molecule set forth with Seq ID No 1, 4-8, 10-18, 20, 22, 24-32, 34-35, 38-40, 43-46, 49-51, 53-54, 57-61, 63, 65-71, 73, 75-77, 81-82, 88, 91-94 and 96-150. In this regard, nucleic acid molecules at least 90%, 91%, 92%, 93%, 94%, 95%, or 96% identical over their entire length to the same are particularly preferred. Furthermore, those with at least 97% are highly preferred, those with at least 98% and at least 99% are particularly highly preferred, with at least 99% or 99.5% being the more preferred, with 100% identity being especially preferred. Moreover, preferred embodiments in this respect are nucleic adds which encode hyperimmune serum reactive antigens or fragments thereof (polypeptides) which retain substantially the same biological function or activity as the mature polypeptide encoded by said nucleic adds set forth in the Seq ID No 1, 4-8, 10-18, 20, 22, 24-32, 34-35, 38-40, 43-46, 49-51, 53-54, 57-61, 63, 65-71, 73, 75-77, 81-82, 88, 91-94 and 96-150.

Identity, as known in the art and used herein, is the relationship between two or more polypeptide sequences or two or more polynucleotide sequences, as determined by comparing the sequences. In the art, identity also means the degree of sequence relatedness between polypeptide or polynucleotide sequences, as the case may be, as determined by the match between strings of such sequences. Identity can be readily calculated. While there exist a number of methods to measure identity between two polynucleotide or two polypeptide sequences, the term is well known to skilled artisans (e.g. *Sequence Analysis in Molecular Biology*, von Heinje, G., Academic Press, 1987). Preferred methods to determine identity are designed to give the largest match between the sequences tested. Methods to determine identity are codified in computer programs. Preferred computer program methods to determine identity between two sequences include, but are not limited to, GCG program package {Devereux, J. et al., 1984}, BLASTP, BLASTN, and FASTA {Altschul, S. et al., 1990}.

According to another aspect of the invention, nucleic acid molecules are provided which exhibit at least 96% identity to the nucleic acid sequence set forth with Seq ID No 64.

According to a further aspect of the present invention, nucleic acid molecules are provided which are identical to the nucleic add sequences set forth with Seq ID No 3, 36, 47-48, 55, 62, 72, 80, 84, 95.

The nucleic add molecules according to the present invention can as a second alternative also be a nucleic acid molecule which is at least essentially complementary to the nucleic acid described as the first alternative above. As used herein complementary means that a nucleic acid strand is base pairing via Watson-Crick base pairing with a second nucleic acid strand. Essentially complementary as used herein means that the base pairing is not occurring for all of the bases of the respective strands but leaves a certain number or percentage of the bases unpaired or wrongly paired. The percentage of correctly pairing bases is preferably at least 70%, more preferably 80%, even more preferably 90% and most preferably any percentage higher than 90%. It is to be noted that a percentage of 70% matching bases is considered as homology and the hybridization having this extent of matching base pairs is considered as stringent. Hybridization conditions for this kind of stringent hybridization may be taken from Current Protocols in Molecular Biology Cohn Wiley and Sons, Inc., 1987). More particularly, the hybridization conditions can be as follows:

Hybridization performed e.g. in 5×SSPE, 5× Denhardt's reagent, 0.1% SDS, 100 g/mL sheared DNA at 68° C.

Moderate stringency wash in 0.2×SSC, 0.1% SDS at 42° C.

High stringency wash in 0.1×SSC, 0.1% SDS at 68° C.

Genomic DNA with a GC content of 50% has an approximate $T_M$ of 96° C. For 1% mismatch, the $T_M$ is reduced by approximately 1° C.

In addition, any of the further hybridization conditions described herein are in principle applicable as well.

Of course, all nucleic acid sequence molecules which encode for the same polypeptide molecule as those identified by the present invention are encompassed by any disclosure of a given coding sequence, since the degeneracy of the genetic code is directly applicable to unambiguously determine all possible nucleic acid molecules which encode a given polypeptide molecule, even if the number of such degenerated nucleic acid molecules may be high. This is also applicable for fragments of a given polypeptide, as long as the fragments encode for a polypeptide being suitable to be used in a vaccination connection, e.g. as an active or passive vaccine.

The nucleic acid molecule according to the present invention can as a third alternative also be a nucleic acid which comprises a stretch of at least 15 bases of the nucleic acid molecule according to the first and second alternative of the nucleic acid molecules according to the present invention as outlined above. Preferably, the bases form a contiguous stretch of bases. However, it is also within the scope of the present invention that the stretch consists of two or more moieties which are separated by a number of bases.

The nucleic acid molecule according to the present invention can as a fourth alternative also be a nucleic acid molecule which anneals under stringent hybridisation conditions to any of the nucleic acids of the present invention according to the above outlined first, second, and third alternative. Stringent hybridisation conditions are typically those described herein.

Finally, the nucleic acid molecule according to the present invention can as a fifth alternative also be a nucleic acid molecule which, but for the degeneracy of the genetic code, would hybridise to any of the nucleic acid molecules according to any nucleic acid molecule of the present invention according to the first, second, third, and fourth alternative as outlined above. This kind of nucleic acid molecule refers to the fact that preferably the nucleic acids according to the present invention code for the hyperimmune serum reactive antigens or fragments thereof according to the present invention. This kind of nucleic acid molecule is particularly useful in the detection of a nucleic add molecule according to the present invention and thus the diagnosis of the respective microorganisms such as S. pyogenes and any disease or diseased condition where this kind of microorganims is involved. Preferably, the hybridisation would occur or be preformed under stringent conditions as described in connection with the fourth alternative described above.

Nucleic acid molecule as used herein generally refers to any ribonucleic acid molecule or deoxyribonucleic acid molecule, which may be unmodified RNA or DNA or modified RNA or DNA. Thus, for instance, nucleic acid molecule as used herein refers to, among other, single-and double-stranded DNA, DNA that is a mixture of single- and double-stranded RNA, and RNA that is a mixture of single- and double-stranded regions, hybrid molecules comprising DNA and RNA that may be single-stranded or, more typically, double-stranded, or triple-stranded, or a mixture of single- and double-stranded regions. In addition, nucleic acid molecule as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. As used herein, the term nucleic acid molecule includes DNAs or RNAs as described above that contain one or more modified bases. Thus, DNAs or RNAs with backbones modified for stability or for other reasons are "nucleic acid molecule" as that term is intended herein. Moreover, DNAs or RNAs comprising unusual bases, such as inosine, or modified bases, such as tritylated bases, to name just two examples, are nucleic acid molecule as the term is used herein. It will be appreciated that a great variety of modifications have been made to DNA and RNA that serve many useful purposes known to those of skill in the art. The term nucleic acid molecule as it is employed herein embraces such chemically, enzymatically or metabolically modified forms of nucleic acid molecule, as well as the chemical forms of DNA and RNA characteristic of viruses and cells, including simple and complex cells, inter alia. The term nucleic acid molecule also embraces short nucleic acid molecules often referred to as oligonucleotide(s). "Polynucleotide" and "nucleic acid" or "nucleic acid molecule" are often used interchangeably herein.

Nucleic acid molecules provided in the present invention also encompass numerous unique fragments, both longer and shorter than the nucleic acid molecule sequences set forth in the sequencing listing of the S. pyogenes coding regions, which can be generated by standard cloning methods. To be unique, a fragment must be of sufficient size to distinguish it from other known nucleic acid sequences, most readily determined by comparing any selected S. pyogenes fragment to the nucleotide sequences in computer databases such as GenBank.

Additionally, modifications can be made to the nucleic acid molecules and polypeptides that are encompassed by the present invention. For example, nucleotide substitutions can be made which do not affect the polypeptide encoded by the nucleic acid, and thus any nucleic acid molecule which encodes a hyperimmune serum reactive antigen or fragments thereof is encompassed by the present invention.

Furthermore, any of the nucleic acid molecules encoding hyperimmune serum reactive antigens or fragments thereof provided by the present invention can be functionally linked, using standard techniques such as standard cloning techniques, to any desired regulatory sequences, whether a *S. pyogenes* regulatory sequence or a heterologous regulatory sequence, heterologous leader sequence, heterologous marker sequence or a heterologous coding sequence to create a fusion protein.

Nucleic acid molecules of the present invention may be in the form of RNA, such as mRNA or cRNA, or in the form of DNA, including, for instance, cDNA and genomic DNA obtained by cloning or produced by chemical synthetic techniques or by a combination thereof. The DNA may be triple-stranded, double-stranded or single-stranded. Single-stranded DNA may be the coding strand, also known as the sense strand, or it may be the non-coding strand, also referred to as the anti-sense strand.

The present invention further relates to variants of the herein above described nucleic acid molecules which encode fragments, analogs and derivatives of the hyperimmune serum reactive antigens and fragments thereof having a deducted *S. pyogenes* amino acid sequence set forth in the Sequence Listing. A variant of the nucleic acid molecule may be a naturally occurring variant such as a naturally occurring allelic variant, or it may be a variant that is not known to occur naturally. Such non-naturally occurring variants of the nucleic acid molecule may be made by mutagenesis techniques, including those applied to nucleic acid molecules, cells or organisms.

Among variants in this regard are variants that differ from the aforementioned nucleic acid molecules by nucleotide substitutions, deletions or additions. The substitutions, deletions or additions may involve one or more nucleotides. The variants may be altered in coding or non-coding regions or both. Alterations in the coding regions may produce conservative or non-conservative amino acid substitutions, deletions or additions. Preferred are nucleic acid molecules encoding a variant, analog, derivative or fragment, or a variant, analogue or derivative of a fragment, which have a *S. pyogenes* sequence as set forth in the Sequence Listing, in which several, a few, 5 to 10, 1 to 5, 1 to 3, 2, 1 or no amino acid(s) is substituted, deleted or added, in any combination. Especially preferred among these are silent substitutions, additions and deletions, which do not alter the properties and activities of the *S. pyogenes* polypeptides set forth in the Sequence Listing. Also especially preferred in this regard are conservative substitutions.

The peptides and fragments according to the present invention also include modified epitopes wherein preferably one or two of the amino acids of a given epitope are modified or replaced according to the rules disclosed in e.g. {Tourdot, S. et al., 2000}, as well as the nucleic acid sequences encoding such modified epitopes.

It is dear that also epitopes derived from the present epitopes by amino add exchanges improving, conserving or at least not significantly impeding the T cell activating capability of the epitopes are covered by the epitopes according to the present invention. Therefore the present epitopes also cover epitopes, which do not contain the original sequence as derived from *S. pyogenes*, but trigger the same or preferably an improved T cell response. These epitope are referred to as "heteroclitic"; they need to have a similar or preferably greater affinity to MHC/HLA molecules, and the need the ability to stimulate the T cell receptors (TCR) directed to the original epitope in a similar or preferably stronger manner.

Heteroclitic epitopes can be obtained by rational design i.e. taking into account the contribution of individual residues to binding to MHC/HLA as for instance described by {Rammensee, H. et al., 1999}, combined with a systematic exchange of residues potentially interacting with the TCR and testing the resulting sequences with T cells directed against the original epitope. Such a design is possible for a skilled man in the art without much experimentation.

Another possibility includes the screening of peptide libraries with T cells directed against the original epitope. A preferred way is the positional scanning of synthetic peptide libraries. Such approaches have been described in detail for instance by {Hemmer, B. et al., 1999} and the references given therein.

As an alternative to epitopes represented by the present derived amino add sequences or heteroclitic epitopes, also substances mimicking these epitopes e.g. "peptidemimetica" or "retro-inverso-peptides" can be applied.

Another aspect of the design of improved epitopes is their formulation or modification with substances increasing their capacity to stimulate T cells. These include T helper cell epitopes, lipids or liposomes or preferred modifications as described in WO 01/78767.

Another way to increase the T cell stimulating capacity of epitopes is their formulation with immune stimulating substances for instance cytokines or chemokines like interleukin-2, -7, -12, -18, class I and II interferons (IFN), especially IFN-gamma, GM-CSF, TNF-alpha, flt3-ligand and others.

As discussed additionally herein regarding nucleic acid molecule assays of the invention, for instance, nucleic add molecules of the invention as discussed above, may be used as a hybridization probe for RNA, cDNA and genomic DNA to isolate full-length cDNAs and genomic clones encoding polypeptides of the present invention and to isolate cDNA and genomic clones of other genes that have a high sequence similarity to the nucleic add molecules of the present invention. Such probes generally will comprise at least 15 bases. Preferably, such probes will have at least 20, at least 25 or at least 30 bases, and may have at least 50 bases. Particularly preferred probes will have at least 30 bases, and will have 50 bases or less, such as 30, 35, 40, 45, or 50 bases.

For example, the coding region of a nucleic acid molecule of the present invention may be isolated by screening a relevant library using the known DNA sequence to synthesize an oligonucleotide probe. A labeled oligonucleotide having a sequence complementary to that of a gene of the present invention is then used to screen a library of cDNA, genomic DNA or mRNA to determine to which members of the library the probe hybridizes.

The nucleic acid molecules and polypeptides of the present invention may be employed as reagents and materials for development of treatments of and diagnostics for disease, particularly human disease, as further discussed herein relating to nucleic add molecule assays, inter alia.

The nucleic acid molecules of the present invention that are oligonucleotides can be used in the processes herein as described, but preferably for PCR, to determine whether or not the *S. pyogenes* genes identified herein in whole or in part are present and/or transcribed in infected tissue such as blood. It is recognized that such sequences will also have utility in diagnosis of the stage of infection and type of infection the pathogen has attained. For this and other purposes the arrays comprising at least one of the nucleic acids according to the present invention as described herein, may be used.

The nucleic acid molecules according to the present invention may be used for the detection of nucleic acid molecules and organisms or samples containing these nucleic acids. Preferably such detection is for diagnosis, more preferable for the diagnosis of a disease related or linked to the present or abundance of S. pyogenes.

Eukaryotes (herein also "individual(s)"), particularly mammals, and especially humans, infected with S. pyogenes may be detected at the DNA level by a variety of techniques. Preferred candidates for distinguishing a S. pyogenes from other organisms can be obtained.

The invention provides a process for diagnosing disease, arising from infection with S. pyogenes, comprising determining from a sample isolated or derived from an individual an increased level of expression of a nucleic acid molecule having the sequence of a nucleic acid molecule set forth in the Sequence Listing. Expression of nucleic acid molecules can be measured using any one of the methods well known in the art for the quantitation of nucleic acid molecules, such as, for example, PCR, RT-PCR, Rnase protection, Northern blotting, other hybridisation methods and the arrays described herein.

Isolated as used herein means separated "by the hand of man" from its natural state; i.e., that, if it occurs in nature, it has been changed or removed from its original environment, or both. For example, a naturally occurring nucleic acid molecule or a polypeptide naturally present in a living organism in its natural state is not "isolated," but the same nucleic acid molecule or polypeptide separated from the coexisting materials of its natural state is "isolated", as the term is employed herein. As part of or following isolation, such nucleic acid molecules can be joined to other nucleic acid molecules, such as DNAs, for mutagenesis, to form fusion proteins, and for propagation or expression in a host, for instance. The isolated nucleic acid molecules, alone or joined to other nucleic acid molecules such as vectors, can be introduced into host cells, in culture or in whole organisms. Introduced into host cells in culture or in whole organisms, such DNAs still would be isolated, as the term is used herein, because they would not be in their naturally occurring form or environment. Similarly, the nucleic acid molecules and polypeptides may occur in a composition, such as a media formulations, solutions for introduction of nucleic acid molecules or polypeptides, for example, into cells, compositions or solutions for chemical or enzymatic reactions, for instance, which are not naturally occurring compositions, and, therein remain isolated nucleic acid molecules or polypeptides within the meaning of that term as it is employed herein.

The nucleic acids according to the present invention may be chemically synthesized. Alternatively, the nucleic acids can be isolated from S. pyogenes by methods known to the one skilled in the art.

According to another aspect of the present invention, a comprehensive set of novel hyperimmune serum reactive antigens and fragments thereof are provided by using the herein described antigen identification method. In a preferred embodiment of the invention, a hyperimmune serum-reactive antigen comprising an amino acid sequence being encoded by any one of the nucleic acids molecules herein described and fragments thereof are provided. In another preferred embodiment of the invention a novel set of hyperimmune serum-reactive antigens which comprises amino acid sequences selected from a group consisting of the polypeptide sequences as represented in Seq ID No 151, 154-158, 160-168, 170, 172, 174-182, 184-185, 188-190, 193-196, 199-201, 203-204, 207-211, 213, 215-221, 223, 225-227, 231-232, 238, 241-244 and 246-300 and fragments thereof are provided. In a further preferred embodiment of the invention hyperimmune serum-reactive antigens which comprise amino acid sequences selected from a group consisting of the polypeptide sequences as represented in Seq ID No214 and fragments thereof are provided. In a still preferred embodiment of the invention hyperimmune serum-reactive antigens which comprise amino acid sequences selected from a group consisting of the polypeptide sequences as represented in Seq ID No 153, 186, 197-198, 205, 212, 222, 230, 234, 245. and fragments thereof are provided.

The hyperimmune serum reactive antigens and fragments thereof as provided in the invention include any polypeptide set forth in the Sequence Listing as well as polypeptides which have at least 70% identity to a polypeptide set forth in the Sequence Listing, preferably at least 80% or 85% identity to a polypeptide set forth in the Sequence Listing, and more preferably at least 90% similarity (more preferably at least 90% identity) to a polypeptide set forth in the Sequence Listing and still more preferably at least 95%, 96%, 97%, 98%, 99% or 99.5% similarity (still more preferably at least 95%, 96%, 97%, 98%, 99%, or 99.5% identity) to a polypeptide set forth in the Sequence Listing and also include portions of such polypeptides with such portion of the polypeptide generally containing at least 4 amino acids and more preferably at least 8, still more preferably at least 30, still more preferably at least 50 amino acids, such as 4, 8, 10, 20, 30, 35, 40, 45 or 50 amino acids.

The invention also relates to fragments, analogs, and derivatives of these hyperimmune serum reactive antigens and fragments thereof. The terms "fragment", "derivative" and "analog" when referring to an antigen whose amino acid sequence is set forth in the Sequence Listing, means a polypeptide which retains essentially the same biological function or activity as such hyperimmune serum reactive antigen and fragment thereof.

The fragment, derivative or analog of a hyperimmune serum reactive antigen and fragment thereof may be 1) one in which one or more of the amino acid residues are substituted with a conserved or non-conserved amino acid residue (preferably a conserved amino acid residue) and such substituted amino add residue may or may not be one encoded by the genetic code, or 2) one in which one or more of the amino acid residues includes a substituent group, or 3) one in which the mature hyperimmune serum reactive antigen or fragment thereof is fused with another compound, such as a compound to increase the half-life of the hyperimmune serum reactive antigen and fragment thereof (for example, polyethylene glycol), or 4) one in which the additional amino acids are fused to the mature hyperimmune serum reactive antigen or fragment thereof, such as a leader or secretory sequence or a sequence which is employed for purification of the mature hyperimmune serum reactive antigen or fragment thereof or a proprotein sequence. Such fragments, derivatives and analogs are deemed to be within the scope of those skilled in the art from the teachings herein.

The present invention also relates to antigens of different S. pyogenes isolates. Such homologues may easily be isolated based on the nucleic acid and amino acid sequences disclosed herein. There are more than 80 M protein serotypes distinguished to date and the typing is based on the variable region at the 5' end of the emm gene (see e.g. Vitali et al. 2002). The presence of any antigen can accordingly be determined for every M serotype. In addition it is possible to determine the variability of a particular antigen in the various M serotypes as described for the sic gene (Hoe et al., 2001). The influence of the various M serotypes on the kind of disease it causes is summarized in a recent review (Cunningham, 2000). In particular, two groups of serotypes can be distinguished:
1) Those causing Pharyngitis and Scarlet fever (e.g. M types 1, 3, 5, 6, 14, 18, 19, 24)
2) Those causing Pyoderma and *Streptococcal* skin infections (e.g. M types 2, 49, 57, 59, 60, 61)

This can serve as the basis to identify the relevance of an antigen for the use as a vaccine or in general as a drug targeting a specific disease.

The information e.g. from the homepage of the CDC (http://www.cdc.gov/ncidod/biotech/etypes.htm) gives a dendrogram showing the relatedness of various M serotypes. Further relevant references are Vitali et al., Journal of Clinical Microbiology 40:679-681. (2002) (molecular emm typing method), Enright et al., Infection and Immunity 69:2416-2427. (2001) (alternative molecular typing method 0,), Hoe et al., The Journal of Infectious Diseases 183633-639. (2001) (example for the variation of one antigen (sic) in many different serotypes) and Cunningham, CLINICAL MICROBIOLOGY REVIEWS 13470-511. (2000)(review on GAS pathogenesis). All emm types are completely listed and may be downloaded from the above mentioned address.

The dendrogram was constructed by sequential use of the Wisconsin Package Version 10.1, Genetics Computer Group (GCG), Madison programs Pileup, Distances, and Growtree. Basically, 22 residues of signal sequence plus 83 additional N terminal residues were used for the alignments which include selected sequences from the database. The selected sequences include new emm designations 103-124 (described in table below) as well as their closest "classical" M protein matches. Although this analysis is limited in that the C terminal ends are truncated arbitrarily, this is a typical result in that the dendrogram separates clusters of opacity factor positive strain M sequences from opacity factor strain negative M sequences.

emm type/previous designation—GenBank accession number—Countries where isolated—Closest N-terminal M protein sequence match (% identity):

emm103/st2034 U74320 PNG, Bra, Egy, Mal, Nep, NZ, US M87 (66%)
emm104/st2034 AF056300 PNG, Egy, Mal, Nep, NZ, US M66 (72%)
emm105/st4529 AF060227 Mal, Nep, NZ, US M5 (45%)
emm106/st4532 AF077666 Mal, Egy, Iran, Nep M27G (71%)
emm107/st4264 AF163686 Mal, NZ M25 (52%)
emm108/st4547 AF052426 Mal, Bra, Egy, Ira, NZ M70 (84%) emm109/st3018 AF077667 Mal, Egy, NZ M28 (74%)
emm110/st4935 U92492 Ind, Bul, NZ, Rus, US M13 (60%)
emm111/st4973 AF128960 Ind, Bra, Nep, US M80 (40%)
emm112/stCmuk16 AF091806 Thi, Bra, Rus, US M27L/77 (59%) emm113/st2267 AF078068 NZ, Thai, Chi M13 (50%)
emm114/st2967 U50338 US, Can, Gam, NZ, PNG M73 (80%)
emm115/st2980 AF028712 US, Bra, Rus M36 (64%)
emm116/st2370 AF156180 US, Nep, NZ M52 (60%)
emm117/st436 AF058801 US M13 (59%)
emm118/st448 AF058802 US, Bra, Egy, Nep, NZ M49 (79%)
emm119/st3365 AF083874 US, Br, Nep M52 (59%)
emm120/st1135 AF296181 Egy M56 (78%)
emm121/st1161 AF296182 Egy M64 (64%)
emm122/st1432 AF222860 Egy, Rus, Nep M18 (40%)
emm123/st6949 AF213451Arg, US, NZM80 (68%)
st1160/emm124AF149048 and AF018178Egy, Mal, NZM2 (82%)

Abbreviations: Arg, Argentina; Bra, Brazil; Bul, Bulgaria; Can, Canada; Chi, Chile; Egy, Egypt; Gam, Gambia; Ind, India; Ira, Iran; Mal, Malaysia; Nep, Nepal; NZ, New Zealand; PNG, Papua New Guinea; Thi, Thailand; Rus, Russia; US, United States. %: Closest mature M protein sequence match to predicted 50 mature N terminal residues from serologically characterized Lancefield type.

emm Types and Sequence Types:

In many cases the emm sequence reference strains came directly from the M type collection of Dr. Rebecca Lancefield. Such strains are designated RCL.

The sequences starting with "emm" indicate that isolates represented by this type have been analyzed by several reference laboratories besides the CDC streptococcal laboratories. Each of the "new" emm types emm94 through emm124 are represented by multiple independent isolates recovered from serious disease manifestations, are M protein nontypeable with all typing sera stocks available to international GAS reference laboratories, and demonstrate antiphagocytic properties in vitro by multiplying in normal human blood. Strains with emm sequences starting with "st" (sequence type) have not yet been completely validated by all of the reference laboratories.

GAS Genetics:

It has long been known that antiserum against serum opacity factor positive (SOF+) strains inhibits OF activity in a strain-specific manner. Therefore, 500-2700 base variable regions of the sof (serum opacity factor) gene representing at least 60 distinct sof genes were analysed from GAS opacity factor positive strains (and interestingly, a homolog commonly found in OF negative emm12 isolates and emm/M type 12 reference strain). It was found that sof gene sequences are also remarkably variable among the different GAS strains, although usually well conserved within an emm type. Important strains include therefore emm1, emm100, emm101, emm102, emm103, emm104, emm105, emm106, emm107, emm108, emm109, emm11, emm110, emm111, emm112, emm113, emm114, emm115, emm116, emm117, emm118, emm119, emm12, emm121, emm121, emm122, emm123, emm124, emm13L, emm14, emm15, emm17, emm18, emm19, emm2, emm22, emm23, emm24, emm25, emu26, emm27G, emm28, emm29, emm3, emm30, emm31, emm32, emm33, emm34, emm36, emm37, emm38, emm39, emm4, emm40, emm41, emm42, emm43, emm44, emm46, emm47, emm48, emm49, emm5, emm50, emm51, emm52, emm53, emm54, emm55, emm56, emm57, emm58, emm59, emm6, emm60, emm61, emm62, emm63, emm64, emm65, emm66, emm67, emm68,mm69, emm70, emm71, emm72, emm73, emm74, emm75, emm76, emm77, emm78, emm79, emm8, emm80, emm81, emm82, emm83, emm84, emm85, emm86, emm87, emm88, emm89, emm9, emm90, emm91, emm92, emm93, emm94, emm95, emm96, emm97, emm98, emm99, st1389, st1731, st1759, st1815 , st1967, st1969, st1rp31, st11014, st2037, st204, st211, st213, st2147, st1207, st245, st2460, st2461, st2463, st2904, st2911, st2917, st2926, st2940, st369, st3757, st3765, st3850, st5282, st6735, st7700, st809, st833, st854, st980584, stck249, stck401, std432, std631, std633, stIL103, stIL62, stns292, stns554, sts104, stc1400, stc1741, stc36, stc3852, stc5344, stc5345, stc57, stc6979, stc74a, stc839, stg10, stg11, stg1389, stg166b, stg1750, stg2078, stg3390, stg4222, stg4545, stg480, stg4831, stg485, stg4974, stg5063, stg6, stg62647, stg643, stg652, stg653, stg663, stg840, stg93464, stg97, stL1376, stL1929 and stL2764.

Among the particularly preferred embodiments of the invention in this regard are the hyperimmune serum reactive antigens set forth in the Sequence Listing, variants, analogs, derivatives and fragments thereof, and variants, analogs and derivatives of fragments. Additionally, fusion polypeptides comprising such hyperimmune serum reactive antigens, variants, analogs, derivatives and fragments thereof, and variants, analogs and derivatives of the fragments are also encompassed by the present invention. Such fusion polypeptides and proteins, as well as nucleic acid molecules encoding them, can readily be made using standard techniques, including standard recombinant techniques for producing and expression a recombinant polynucleic acid encoding a fusion protein.

Among preferred variants are those that vary from a reference by conservative amino acid substitutions. Such substitutions are those that substitute a given amino acid in a polypeptide by another amino acid of like characteristics. Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe and Tyr.

Further particularly preferred in this regard are variants, analogs, derivatives and fragments, and variants, analogs and derivatives of the fragments, having the amino acid sequence of any polypeptide set forth in the Sequence Listing, in which several, a few, 5 to 10, 1 to 5, 1 to 3, 2, 1 or no amino acid residues are substituted, deleted or added, in any combination. Especially preferred among these are silent substitutions, additions and deletions, which do not alter the properties and activities of the polypeptide of the present invention. Also especially preferred in this regard are conservative substitutions. Most highly preferred are polypeptides having an amino acid sequence set forth in the Sequence Listing without substitutions. Specifically suitable amino acid substitutions are those which are contained in homologues for the sequences disclosed in the Sequence Listing according to the present application. A suitable sequence derivative of an antigen or epitope as disclosed herein therefore includes one or more variations being present in one or more strains or serotypes of S. pyogenes (preferably 1, 2, 3, 4, 5, 6, 7, 8, 9, or 10 amino acid exchanges which are based on such homolog variations). Such antigens comprise sequences which may be naturally occurring sequences or newly created artificial sequences. These preferred antigen variants are based on such naturally occurring sequence variations, e.g. forming a "master sequence" for the antigenic regions of the polypeptides according to the present invention. Suitable examples for such homolog variations or exchanges are given in table 5 in the example section. For example, a given S. pyogenes sequence may be amended by including such one or more variations thereby creating an artificial (i.e. non-naturally occurring) variant of this given (naturally occurring) antigen or epitope sequence.

The hyperimmune serum reactive antigens and fragments thereof of the present invention are preferably provided in an isolated form, and preferably are purified to homogeneity.

Also among preferred embodiments of the present invention are polypeptides comprising fragments of the polypeptides having the amino acid sequence set forth in the Sequence Listing, and fragments of variants and derivatives of the polypeptides set forth in the Sequence Listing.

In this regard a fragment is a polypeptide having an amino acid sequence that entirely is the same as part but not all of the amino acid sequence of the afore mentioned hyperimmune serum reactive antigen and fragment thereof, and variants or derivative, analogs, fragments thereof. Such fragments may be "free-standing", i.e., not part of or fused to other amino acids or polypeptides, or they may be comprised within a larger polypeptide of which they form a part or region. Also preferred in this aspect of the invention are fragments characterised by structural or functional attributes of the polypeptide of the present invention, i.e. fragments that comprise alpha-helix and alpha-helix forming regions, beta-sheet and beta-sheet forming regions, turn and turn-forming regions, coil and coil-forming regions, hydrophilic regions, hydrophobic regions, alpha amphipathic regions, beta-amphipathic regions, flexible regions, surface-forming regions, substrate binding regions, and high antigenic index regions of the polypeptide of the present invention, and combinations of such fragments. Preferred regions are those that mediate activities of the hyperimmune serum reactive antigens and fragments thereof of the present invention. Most highly preferred in this regard are fragments that have a chemical, biological or other activity of the hyperimmune serum reactive antigen and fragments thereof of the present invention, including those with a similar activity or an improved activity, or with a decreased undesirable activity. Particularly preferred are fragments comprising receptors or domains of enzymes that confer a function essential for viability of S. pyogenes or the ability to cause disease in humans. Further preferred polypeptide fragments are those that comprise or contain antigenic or immunogenic determinants in an animal, especially in a human.

An antigenic fragment is defined as a fragment of the identified antigen which is for itself antigenic or may be made antigenic when provided as a hapten. Therefore, also antigens- or antigenic fragments showing one or (for longer fragments) only a few amino acid exchanges are enabled with the present invention, provided that the antigenic capacities of such fragments with amino acid exchanges are not severely deteriorated on the exchange(s), i.e., suited for eliciting an appropriate immune response in an individual vaccinated with this antigen and identified by individual antibody preparations from individual sera.

Preferred examples of such fragments of a hyperimmune serum-reactive antigen are selected from the group consisting of peptides comprising amino acid sequences of column "predicted immunogenic aa", and "Location of identified immunogenic region" of Table 1; the serum reactive epitopes of Table 2, especially peptides comprising amino acid 4-44, 57-65, 67-98, 101-107, 109-125, 131-144, 146-159, 168-173, 181-186, 191-200, 206-213, 229-245, 261-269, 288-301, 304-317, 323-328, 350-361, 374-384, 388-407, 416-425 and 1-114 of Seq ID No 151; 5-17, 49-64, 77-82, 87-98, 118-125, 127-140, 142-150, 153-159, 191-207, 212-218, 226-270, 274-287, 297-306, 325-331, 340-347, 352-369, 377-382, 390-395 and 29-226 of Seq ID No 152; 4-16, 20-26, 32-74, 76-87, 93-108, 116-141, 148-162, 165-180, 206-219, 221-228, 230-236, 239-245. 257-268, 313-328, 330-335, 353-359, 367-375, 394-403, 414-434, 437-444, 446-453, 456-464, 478-487, 526-535, 541-552, 568-575, 577-584, 589-598, 610-618, 624-643, 653-665, 667-681, 697-718, 730-748, 755-761, 773-794, 806-821, 823-831, 837-845, 862-877, 879-889, 896-919, 924-930, 935-940, 947-955, 959-964, 969-986, 991-1002, 1012-1036, 1047-1056, 1067-1073, 1079-1085, 1088-1111, 1130-1135, 1148-1164, 1166-1173, 1185-1192, 1244-1254 and 919-929 of Seq ID No 153; 5-44, 62-74, 78-83, 99-105, 107-113, 124-134, 161-174, 176-194, 203-211, 216-237, 241-247, 253-266, 272-299, 323-349, 353-360 and 145-305 of Seq ID No 154; 15-39, 52-61, 72-81, 92-97 and 71-81 of Seq ID No 155; 13-19, 21-31, 40-108, 115-122, 125-140, 158-180, 187-203, 210-223, 235-245 and 173-186 of Seq ID No 156; 5-12, 19-27, 29-39, 59-67, 71-78, 80-88, 92-104, 107-124, 129-142, 158-168, 185-191, 218-226, 230-243, 256-267, 272-277, 283-291, 307-325, 331-344, 346-352 and 316-331 of Seq ID No 157; 6-28, 43-53, 60-76, 93-103 and 21-99 of Seq ID No 158; 10-30, 120-126, 145-151, 159-169, 174-182, 191-196, 201-206, 214-220, 222-232, 254-272, 292-307, 313-323, 332-353, 361-369, 389-396, 401-415, 428-439, 465-481, 510-517, 560-568 and 9-264 of Seq ID No 159; 5-29, 39-45, 107-128 and 1-112 of Seq ID No 160; 4-38, 42-50, 54-60, 65-71, 91-102 and 21-56 of Seq ID No 161; 4-13, 19-25, 41-51, 54-62, 68-75, 79-89, 109-122, 130-136, 172-189, 192-198, 217-224, 262-268, 270-276, 281-298, 315-324, 333-342, 353-370, 376-391 and 23-39 of Seq ID No 162; 6-41, 49-58, 62-103, 117-124, 147-166, 173-194, 204-211, 221-229, 255-261, 269-284, 288-310, 319-325, 348-380, 383-389, 402-410, 424-443, 467-479, 496-517, 535-553, 555-565, 574-581, 583-591 and 474-489 of Seq ID No 163; 8-35, 52-57, 66-73, 81-88, 108-114, 125-131, 160-167, 174-180, 230-235, 237-249, 254-262, 278-285, 308-314, 321-326, 344-353, 358-372, 376-383, 393-411, 439-446, 453-464, 471-480, 485-492, 502-508, 523-529, 533-556, 558-563, 567-584, 589-597, 605-619, 625-645, 647-666, 671-678, 690-714, 721-728, 741-763, 776-773, 777-787, 792-802, 809-823, 849-864 and 37-241, 409-534, 582-604, 743-804 of Seq ID No 164; 4-17, 24-36, 38-44, 59-67, 72-90, 92-121, 126-149, 151-159, 161-175, 197-215, 217-227, 241-247, 257-264, 266-275, 277-284, 293-307, 315-321, 330-337, 345-350, 357-366, 385-416 and 202-337 of Seq ID No 165; 4-20, 22-46, 49-70, 80-89, 96-103, 105-119, 123-129, 153-160, 181-223, 227-233, 236-243, 248-255, 261-269, 274-279, 283-299, 305-313, 315-332, 339-344, 349-362, 365-373, 380-388, 391-397, 402-407 and 1-48 of Seq ID No 166; 18-37, 41-63, 100-106, 109-151, 153-167, 170-197, 199-207, 212-229, 232-253, 273-297 and 203-217 of Seq ID No 167; 20-26, 54-61, 80-88, 94-101, 113-119, 128-136, 138-144, 156-188, 193-201, 209-217, 221-229, 239-244, 251-257, 270-278, 281-290, 308-315, 319-332, 339-352, 370-381, 388-400, 411-417, 426-435, 468-482, 488-497, 499-506, 512-521 and 261-273 of Seq ID No 168; 6-12, 16-36, 50-56, 86-92, 115-125, 143-152, 163-172, 193-203, 235-244, 280-289, 302-315, 325-348, 370-379, 399-405, 411-417, 419-429, 441-449, 463-472, 482-490, 500-516, 536-543, 561-569, 587-594, 620-636, 647-653, 659-664, 677-685, 687-693, 713-719, 733-740, 746-754, 756-779, 792-799, 808-817, 822-828, 851-865, 902-908, 920-938, 946-952, 969-976, 988-1005, 1018-1027, 1045-1057, 1063-1069, 1071-1078, 1090-1099, 1101-1109, 1113-1127, 1130-1137, 1162-1174, 1211-1221, 1234-1242, 1261-1268, 1278-1284, 1312-1317, 1319-1326, 1345-1353, 1366-1378, 1382-1394, 1396-1413, 1415-1424, 1442-1457, 1467-1474, 1482-1490, 1492-1530, 1537-1549, 1559-1576, 1611-1616, 1624-1641 and 1-414, 443-614, 997-1392 of Seq ID No 169; 14-42, 70-75, 90-100, 158-181 and 1-164 of Seq ID No 170; 4-21, 30-36, 54-82, 89-97, 105-118, 138-147 and 126-207 of Seq ID No 171; 4-21, 31-66, 96-104, 106-113, 131-142 and 180-204 of Seq ID No 172; 5-23, 31-36, 38-55, 65-74, 79-88, 101-129, 131-154, 156-165, 183-194, 225-237, 245-261, 264-271, 279-284, 287-297, 313-319, 327-336, 343-363, 380-386 and 11-197, 204-219, 258-372 of Seq ID No 173; 4-20, 34-41, 71-86, 100-110, 113-124, 133-143, 150-158, 160-166, 175-182, 191-197, 213-223, 233-239, 259-278, 298-322 and 195-289 of Seq ID No 174; 4-10, 21-35, 44-52, 54-62, 67-73, 87-103, 106-135, 161-174, 177-192, 200-209, 216-233, 249-298, 304-312, 315-329 and 12-130 of Seq ID No 175; 10-27, 33-38, 48-55, 70-76, 96-107, 119-133, 141-147, 151-165, 183-190, 197-210, 228-236, 245-250, 266-272, 289-295, 297-306, 308-315, 323-352, 357-371, 381-390, 394-401, 404-415, 417-425, 427-462, 466-483, 485-496, 502-507, 520-529, 531-541, 553-570, 577-588, 591-596, 600-610, 619-632, 642-665, 671-692, 694-707 and 434-444 of Seq ID No 176; 6-14, 16-25, 36-46, 52-70, 83-111, 129-138, 140-149, 153-166, 169-181, 188-206, 212-220, 223-259, 261-269, 274-282, 286-293, 297-306, 313-319, 329-341, 343-359, 377-390, 409-415, 425-430 and 360-375 of Seq ID No 177; 4-26, 28-48, 54-62, 88-121, 147-162, 164-201, 203-237, 245-251 and 254-260 of Seq ID No 178; 12-21, 26-32, 66-72, 87-93, 98-112, 125-149, 179-203, 209-226, 233-242, 249-261, 266-271, 273-289, 293-318, 346-354, 360-371, 391-400 and 369-382 of Seq ID No 179; 11-38, 44-65, 70-87, 129-135, 140-163, 171-177, 225-232, 238-249, 258-266, 271-280, 284-291, 295-300, 329-337, 344-352, 405-412, 416-424, 426-434, 436-455, 462-475, 478-487 and 270-312 of Seq ID No 180; 5-17, 34-45, 59-69, 82-88, 117-129, 137-142, 158-165, 180-195, 201-206, 219-226, 241-260, 269-279, 292-305, 312-321, 341-347, 362-381, 396-410, 413-432, 434-445, 447-453, 482-487, 492-499, 507-516, 546-552, 556-565, 587-604 and 486-598 of Seq ID No 181; 4-15, 17-32, 40-47, 67-78, 90-98, 101-107, 111-136, 161-171, 184-198, 208-214, 234-245, 247-254, 272-279, 288-298, 303-310, 315-320, 325-333, 338-349, 364-374 and 378-396 of Seq ID No 182; 5-27, 33-49, 51-57, 74-81, 95-107, 130-137, 148-157, 173-184 and 75-235 of Seq ID No 183; 6-23, 47-53, 57-63, 75-82, 97-105, 113-122, 124-134, 142-153, 159-164, 169-179, 181-187, 192-208, 215-243, 247-257, 285-290, 303-310 and 30-51 of Seq ID No 184; 17-29, 44-52, 59-73, 77-83, 86-92, 97-110, 118-153, 156-166, 173-179, 192-209, 225-231, 234-240, 245-251, 260-268, 274-279, 297-306, 328-340, 353-360, 369-382, 384-397, 414-423, 431-436, 452-465, 492-498, 500-508, 516-552, 554-560, 568-574, 580-586, 609-617, 620-626, 641-647 and 208-219 of Seq ID No 185; 4-26, 32-45, 58-72, 111-119, 137-143, 146-159, 187-193, 221-231, 235-242, 250-273, 290-304, 311-321, 326-339, 341-347, 354-368, 397-403, 412-419, 426-432, 487-506, 580-592, 619-628, 663-685, 707-716, 743-751, 770-776, 787-792, 850-859, 866-873, 882-888, 922-931, 957-963, 975-981, 983-989, 1000-1008, 1023-1029, 1058-1064, 1089-1099, 1107-1114, 1139-1145, 1147-1156, 1217-1226, 1276-1281, 1329-1335, 1355-1366, 1382-1394, 1410-1416, 1418-1424, 1443-1451, 1461-1469, 1483-1489, 1491-1501, 1515-1522, 1538-1544, 1549-1561, 1587-1593, 1603-1613, 1625-1630, 1636-1641, 1684-1690, 1706-1723, 1765-1771, 1787-1804, 1850-1857, 1863-1894, 1897-1910, 1926-1935, 1937-1943, 1960-1983, 1991-2005, 2008-2014, 2018-2039 and 396-533, 1342-1502, 1672-1920 of Seq ID No 186; 4-25, 45-50, 53-65, 79-85, 87-92, 99-109, 126-137, 141-148, 156-183, 190-203, 212-217, 221-228, 235-242, 247-277, 287-293, 300-319, 321-330, 341-361, 378-389, 394-406, 437-449, 455-461, 472-478, 482-491, 507-522, 544-554, 576-582, 587-593, 611-621, 626-632, 649-661, 679-685, 696-704, 706-716, 726-736, 740-751, 759-766, 786-792, 797-802, 810-822, 824-832, 843-852, 863-869, 874-879, 882-905 and 1-113, 210-232, 250-423, 536-564 of Seq ID No 187; 4-16, 33-39, 43-49, 54-85, 107-123, 131-147, 157-169, 177-187, 198-209, 220-230, 238-248, 277-286, 293-301, 303-315, 319-379, 383-393, 402-414, 426-432, 439-449, 470-478, 483-497, 502-535, 552-566, 571-582, 596-601, 608-620, 631-643, 651-656, 663-678, 680-699, 705-717, 724-732, 738-748, 756-763, 766-772, 776-791, 796-810, 819-827, 829-841, 847-861, 866-871, 876-882, 887-894, 909-934, 941-947, 957-969, 986-994, 998-1028, 1033-1070, 1073-1080, 1090-1096, 1098-1132, 1134-1159, 1164-1172, 1174-1201 and 617-635 of Seq ID No 188; 7-25, 30-40, 42-64, 70-77, 85-118, 120-166, 169-199, 202-213, 222-244 and 190-203 of Seq ID No 189; 4-11, 15-53, 55-93, 95-113, 120-159, 164-200, 210-243, 250-258, 261-283, 298-319, 327-340, 356-366, 369-376, 380-386, 394-406, 409-421, 425-435, 442-454, 461-472, 480-490, 494-505, 507-514, 521-527, 533-544, 566-574 and 385-398 of Seq ID No 190; 5-36, 66-72, 120-127, 146-152, 159-168, 172-184, 205-210, 221-232, 234-243, 251-275, 295-305, 325-332, 367-373, 470-479, 482-487, 520-548, 592-600, 605-615, 627-642, 655-662, 664-698, 718-725, 734-763, 776-784, 798-809, 811-842, 845-852, 867-872, 879-888, 900-928, 933-940, 972-977, 982-1003 and 12-190, 276-283, 666-806 of Seq ID No 191; 4-38, 63-68, 100-114, 160-173, 183-192, 195-210, 212-219, 221-238, 240-256, 258-266, 274-290, 301-311, 313-319, 332-341, 357-363, 395-401, 405-410, 420-426, 435-450, 453-461, 468-475, 491-498, 510-518, 529-537, 545-552, 585-592, 602-611, 634-639, 650-664 and 30-80, 89-105, 111-151 of Seq ID No 192; 7-29, 31-39, 47-54, 63-74, 81-94, 97-117, 122-127, 146-157, 168-192, 195-204, 216-240, 251-259 and 195-203 of Seq ID No193; 5-16, 28-34, 46-65, 79-94, 98-105, 107-113, 120-134, 147-158, 163-172, 180-186, 226-233, 237-251, 253-259, 275-285, 287-294, 302-308, 315-321, 334-344, 360-371, 399-412, 420-426 and 32-50 of Seq ID No 194; 8-20, 30-36, 71-79, 90-96, 106-117, 125-138, 141-147, 166-174 and 75-90 of Seq ID No 195; 4-13, 15-33, 43-52, 63-85, 98-114, 131-139, 146-174, 186-192, 198-206, 227-233 and 69-88 of Seq ID No 196; 4-22, 29-35, 59-68, 153-170, 213-219, 224-238, 240-246, 263-270, 285-292, 301-321, 327-346, 356-371, 389-405, 411-418, 421-427, 430-437, 450-467, 472-477, 482-487, 513-518, 531-538, 569-576, 606-614, 637-657, 662-667, 673-690, 743-753, 760-767, 770-777, 786-802 and 96-230, 361-491, 572-585 of Seq ID No 197; 4-12, 21-36, 48-55, 74-82, 121-127, 195-203, 207-228, 247-262, 269-278, 280-289 and 102-210 of Seq ID No 198; 13-20, 23-31, 38-44, 78-107, 110-118, 122-144, 151-164, 176-182, 190-198, 209-216, 219-243, 251-256, 289-304, 306-313 and 240-248 of Seq ID No 199; 5-26, 34-48, 57-77, 84-102, 116-132, 139-145, 150-162, 165-173, 176-187, 192-205, 216-221, 234-248, 250-260 and 182-198 of Seq ID No 200; 10-19, 26-44, 53-62, 69-87, 90-96, 121-127, 141-146, 148-158, 175-193, 204-259, 307-313, 334-348, 360-365, 370-401, 411-439, 441-450, 455-462, 467-472, 488-504 and 41-56 of Seq ID No 201; 5-21, 36-42, 96-116, 123-130, 138-144, 146-157, 184-201, 213-228, 252-259, 277-297, 308-313, 318-323, 327-333 and 202-217 of Seq ID No 202; 6-26, 33-51, 72-90, 97-131, 147-154, 164-171, 187-216, 231-236, 260-269, 275-283 and 1-127 of Seq ID No 203; 4-22, 24-38, 44-58, 72-88, 99-108, 110-117, 123-129, 131-137, 142-147, 167-178, 181-190, 206-214, 217-223, 271-282, 290-305, 320-327, 329-336, 343-352, 354-364, 396-402, 425-434, 451-456, 471-477, 485-491, 515-541, 544-583, 595-609, 611-626, 644-656, 660-681, 683-691, 695-718 and 297-458 of Seq ID No 204; 5-43, 92-102, 107-116, 120-130, 137-144, 155-163, 169-174, 193-213 and 24-135 of Seq ID No 205; 4-25, 61-69, 73-85, 88-95, 97-109, 111-130, 135-147, 150-157, 159-179, 182-201, 206-212, 224-248, 253-260, 287-295, 314-331, 338-344, 365-376, 396-405, 413-422, 424-430, 432-449, 478-485, 487-494, 503-517, 522-536, 544-560, 564-578, 585-590, 597-613, 615-623, 629-636, 640-649, 662-671, 713-721 and 176-330 of Seq ID No 206; 31-37, 41-52, 58-79, 82-105, 133-179, 184-193, 199-205, 209-226, 256-277, 281-295, 297-314, 322-328, 331-337, 359-367, 379-395, 403-409, 417-432, 442-447, 451-460, 466-472 and 46-62, 296-341 of Seq ID No 207; 23-29, 56-63, 67-74, 96-108, 122-132, 139-146, 152-159, 167-178, 189-196, 214-231, 247-265, 274-293, 301-309, 326-332, 356-363, 378-395, 406-412, 436-442, 445-451, 465-479, 487-501, 528-555, 567-581, 583-599, 610-617, 622-629, 638-662, 681-686, 694-700, 711-716 and 667-684 of Seq ID No 208; 20-51, 53-59, 109-115, 140-154, 185-191, 201-209, 212-218, 234-243, 253-263, 277-290, 303-313, 327-337, 342-349, 374-382, 394-410, 436-442, 464-477, 486-499, 521-530, 536-550, 560-566, 569-583, 652-672, 680-686, 698-704, 718-746, 758-770, 774-788, 802-827, 835-842, 861-869 and 258-416 of Seq ID No 209; 7-25, 39-45, 59-70, 92-108, 116-127, 161-168, 202-211, 217-227, 229-239, 254-262, 271-278, 291-300 and 278-295 of Seq ID No 210; 4-20, 27-33, 45-51, 53-62, 66-74, 81-88, 98-111, 124-130, 136-144, 156-179, 183-191 and 183-195 of Seq ID No 211; 12-24, 27-33, 43-49, 55-71, 77-85, 122-131, 168-177, 179-203, 209-214, 226-241 and 63-238 of Seq ID No 212; 4-19, 37-50, 120-126, 131-137, 139-162, 177-195, 200-209, 211-218, 233-256, 260-268, 271-283, 288-308 and 1-141 of Seq ID No 213; 11-17, 40-47, 57-63, 96-124, 141-162, 170-207, 223-235, 241-265, 271-277, 281-300, 312-318, 327-333, 373-379 and 231-368 of Seq ID No 214; 9-33, 41-48, 57-79, 97-103, 113-138, 146-157, 165-186, 195-201, 209-215, 223-229, 237-247, 277-286, 290-297, 328-342 and 247-260 of Seq ID No 215; 7-15, 39-45, 58-64, 79-84, 97-127, 130-141, 163-176, 195-203, 216-225, 235-247, 254-264, 271-279 and 64-72 of Seq ID No 216; 4-12, 26-42, 46-65, 73-80, 82-94, 116-125, 135-146, 167-173, 183-190, 232-271, 274-282, 300-306, 320-343, 351-362, 373-383, 385-391, 402-409, 414-426, 434-455, 460-466, 473-481, 485-503, 519-525, 533-542, 554-565, 599-624, 645-651, 675-693, 717-725, 751-758, 767-785, 792-797, 801-809, 819-825, 831-836, 859-869, 890-897 and 222-362, 756-896 of Seq ID No 217; 11-17, 22-28, 52-69, 73-83, 86-97, 123-148, 150-164, 166-177, 179-186, 188-199, 219-225, 229-243, 250-255 and 153-170 of Seq ID No 218; 4-61, 71-80, 83-90, 92-128, 133-153, 167-182, 184-192, 198-212 and 56-73 of Seq ID No 219; 4-19, 26-37, 45-52, 58-66, 71-77, 84-92, 94-101, 107-118, 120-133, 156-168, 170-179, 208-216, 228-238, 253-273, 280-296, 303-317, 326-334 and 298-312 of Seq ID No 220; 7-13, 27-35, 38-56, 85-108, 113-121, 123-160, 163-169, 172-183, 188-200, 206-211, 219-238, 247-254 and 141-157 of Seq ID No 221; 23-39, 45-73, 86-103, 107-115, 125-132, 137-146, 148-158, 160-168, 172-179, 185-192, 200-207, 210-224, 233-239, 246-255, 285-334, 338-352, 355-379, 383-389, 408-417, 423-429, 446-456, 460-473, 478-503, 522-540, 553-562, 568-577, 596-602, 620-636, 640-649, 655-663 and 433-440, 572-593 of Seq ID No 222; 4-42, 46-58, 64-76, 118-124, 130-137, 148-156, 164-169, 175-182, 187-194, 203-218, 220-227, 241-246, 254-259, 264-270, 275-289, 296-305, 309-314, 322-334, 342-354, 398-405, 419-426, 432-443, 462-475, 522-530, 552-567, 593-607, 618-634, 636-647, 653-658, 662-670, 681-695, 698-707, 709-720, 732-742, 767-792, 794-822, 828-842, 851-866, 881-890, 895-903, 928-934, 940-963, 978-986, 1003-1025, 1027-1043, 1058-1075, 1080-1087, 1095-1109, 1116-1122, 1133-1138, 1168-1174, 1179-1186, 1207-1214, 1248-1267 and 17-319, 417-563 of Seq ID No 223; 6-19, 23-33, 129-138, 140-150, 153-184, 190-198, 206-219, 235-245, 267-275, 284-289, 303-310, 322-328, 354-404, 407-413, 423-446, 453-462, 467-481, 491-500 and 46-187 of Seq ID No 224; 4-34, 39-57, 78-86, 106-116, 141-151, 156-162, 165-172, 213-237, 252-260, 262-268, 272-279, 296-307, 332-338, 397-403, 406-416, 431-446, 448-453, 464-470, 503-515, 519-525, 534-540, 551-563, 578-593, 646-668, 693-699, 703-719, 738-744, 748-759, 771-777, 807-813, 840-847, 870-876, 897-903, 910-925, 967-976, 979-992 and 21-244, 381-499, 818-959 of Seq ID No 225; 19-29, 65-75, 90-109, 111-137, 155-165, 169-175 and 118-136 of Seq ID No 226; 15-20, 30-36, 55-63, 73-79, 90-117, 120-127, 136-149, 166-188, 195-203, 211-223, 242-255, 264-269, 281-287, 325-330, 334-341, 348-366, 395-408, 423-429, 436-444, 452-465 and 147-155 of Seq ID No 227; 11-18, 21-53, 77-83, 91-98, 109-119, 142-163, 173-181, 193-208, 216-227, 238-255, 261-268, 274-286, 290-297, 308-315, 326-332, 352-359, 377-395, 399-406, 418-426, 428-438, 442-448, 458-465, 473-482, 488-499, 514-524, 543-553, 564-600, 623-632, 647-654, 660-669, 672-678, 710-723, 739-749, 787-793, 820-828, 838-860, 889-895, 901-907, 924-939, 956-962, 969-976, 991-999, 1012-1018, 1024-1029, 1035-1072, 1078-1091, 1142-1161 and 74-438 of Seq ID No 228; 4-31, 41-52, 58-63, 65-73, 83-88, 102-117, 123-130, 150-172, 177-195, 207-217, 222-235, 247-253, 295-305, 315-328, 335-342, 359-365, 389-394, 404-413 and 156-420 of Seq ID No 229; 4-42, 56-69, 98-108, 120-125, 210-216, 225-231, 276-285, 304-310, 313-318, 322-343 and 79-348 of Seq ID No 230; 12-21, 24-30, 42-50, 61-67, 69-85, 90-97, 110-143, 155-168 and 53-70 of Seq ID No 231; 4-26, 41-54, 71-78, 88-96, 116-127, 140-149, 151-158, 161-175, 190-196, 201-208, 220-226, 240-247, 266-281, 298-305, 308-318, 321-329, 344-353, 370-378, 384-405, 418-426, 429-442, 457-463, 494-505, 514-522 and 183-341 of Seq ID No 232; 4-27, 69-77, 79-101, 117-123, 126-142, 155-161, 171-186, 200-206, 213-231, 233-244, 258-263, 269-275, 315-331, 337-346, 349-372, 376-381, 401-410, 424-445, 447-455, 463-470, 478-484, 520-536, 546-555, 558-569, 580-597, 603-618, 628-638, 648-660, 668-683, 717-723, 765-771, 781-788, 792-806, 812-822 and 92-231, 618-757 of Seq ID No 233; 11-47, 63-75, 108-117, 119-128, 133-143, 171-185, 190-196, 226-232, 257-264, 278-283, 297-309, 332-338, 341-346, 351-358, 362-372 and 41-170 of Seq ID No 234; 6-26, 50-56, 83-89, 108-114, 123-131, 172-181, 194-200, 221-238, 241-259, 263-271, 284-292, 304-319, 321-335, 353-358, 384-391, 408-417, 424-430, 442-448, 459-466, 487-500, 514-528, 541-556, 572-578, 595-601, 605-613, 620-631, 634-648, 660-679, 686-693, 702-708, 716-725, 730-735, 749-755, 770-777, 805-811, 831-837, 843-851, 854-860, 863-869, 895-901, 904-914, 922-929, 933-938, 947-952, 956-963, 1000-1005, 1008-1014, 1021-1030, 1131-1137, 1154-1164, 1166-1174 and 20-487, 757-1153 of Seq ID No 235; 10-34, 67-78, 131-146, 160-175, 189-194, 201-214, 239-250, 265-271, 296-305 and 26-74, 91-100, 105-303 of Seq ID No 236; 9-15, 19-32, 109-122, 143-150, 171-180, 186-191, 209-217, 223-229, 260-273, 302-315, 340-346, 353-359, 377-383, 389-406, 420-426, 460-480 and 10-223, 231-251, 264-297, 312-336 of Seq ID No 237; 5-28, 76-81, 180-195, 203-209, 211-219, 227-234, 242-252, 271-282, 317-325, 350-356, 358-364, 394-400, 405-413, 417-424, 430-436, 443-449, 462-482, 488-498, 503-509, 525-537 and 22-344 of Seq ID No 238; 5-28, 42-54, 77-83, 86-93, 98-104, 120-127, 145-159, 166-176, 181-187, 189-197, 213-218, 230-237, 263-271, 285-291, 299-305, 326-346, 368-375, 390-395 and 1-151 of Seq ID No 239; 6-34, 48-55, 58-64, 84-101, 121-127, 143-149, 153-159, 163-170, 173-181, 216-225, 227-240, 248-254, 275-290, 349-364, 375-410, 412-418, 432-438, 445-451, 465-475, 488-496, 505-515, 558-564, 571-579, 585-595, 604-613, 626-643, 652-659, 677-686, 688-696, 702-709, 731-747, 777-795, 820-828, 836-842, 845-856, 863-868, 874-882, 900-909, 926-943, 961-976, 980-986, 992-998, 1022-1034, 1044-1074, 1085-1096, 1101-1112, 1117-1123, 1130-1147, 1181-1187, 1204-1211, 1213-1223, 1226-1239, 1242-1249, 1265-1271, 1273-1293, 1300-1308, 1361-1367, 1378-1384, 1395-1406, 1420-1428, 1439-1446, 1454-1460, 1477-1487, 1509-1520, 1526-1536, 1557-1574, 1585-1596, 1605-1617, 1621-1627, 1631-1637, 1648-1654, 1675-1689, 1692-1698, 1700-1706, 1712-1719, 1743-1756 and 91-263 of Seq ID No 240; 4-16, 75-90, 101-136, 138-144, 158-164, 171-177, 191-201, 214-222, 231-241, 284-290, 297-305, 311-321, 330-339, 352-369, 378-385, 403-412, 414-422, 428-435, 457-473, 503-521, 546-554, 562-568, 571-582, 589-594, 600-608, 626-635, 652-669, 687-702, 706-712, 718-724, 748-760, 770-775 and 261-272 of Seq ID No 241; 4-19, 30-41, 46-57, 62-68, 75-92, 126-132, 149-156, 158-168, 171-184, 187-194, 210-216, 218-238, 245-253, 306-312, 323-329, 340-351, 365-373, 384-391, 399-405, 422-432, 454-465, 471-481, 502-519, 530-541, 550-562, 566-572, 576-582, 593-599, 620-634, 637-643, 645-651, 657-664, 688-701 and 541-551 of Seq ID No 242; 6-11, 17-25, 53-58, 80-86, 91-99, 101-113, 123-131, 162-169, 181-188, 199-231, 245-252 and 84-254 of Seq ID No 243; 13-30, 71-120, 125-137, 139-145, 184-199 and 61-78 of Seq ID No 244; 9-30, 38-53, 63-70, 74-97, 103-150, 158-175, 183-217, 225-253, 260-268, 272-286, 290-341, 352-428, 434-450, 453-460, 469-478, 513-525, 527-534, 554-563, 586-600, 602-610, 623-640, 656-684, 707-729, 735-749, 757-763, 766-772, 779-788, 799-805, 807-815, 819-826, 831-855 and 568-580 of Seq ID No 245; 11-21, 29-38 and 5-17 of Seq ID No 246; 2-9 of Seq ID No 247; 4-10, 16-28 and 7-18, 26-34 of Seq ID No 248; 10-16 and 1-15 of Seq ID No 249; 4-11 of Seq ID No 250; 4-40, 42-51 and 37-53 of Seq ID No 251; 4-21 and 22-29 of Seq ID No 252; 2-11 Seq ID No 253; 9-17, 32-44 and 1-22 of Seq ID No 254; 19-25, 27-32 and 15-34 of Seq ID No 255; 4-12, 15-22 and 11-33 of Seq ID No 256; 10-17, 24-30, 39-46, 51-70 and 51-61 of Seq ID No 257; 6-19 of Seq ID No 258; 6-11, 21-27, 31-54 and 11-29 of Seq ID No 259; 4-10, 13-45 and 11-35 of Seq ID No 260; 4-14, 23-32 and 11-35 of Seq ID No 261; 14-39, 45-51 and 15-29 of Seq ID No 262; 4-11, 14-28 and 4-17 of Seq ID No 263; 4-16 and 2-16 of Seq ID No 264; 4-10, 12-19, 39-50 and 6-22 of Seq ID No 265; 2-13 of Seq ID No 266; 4-11, 22-65 and 3-19 of Seq ID No 267; 17-23, 30-35, 39-46, 57-62 and 30-49 of Seq ID No 268; 4-19 and 14-22 of Seq ID No 269; 2-9 of Seq ID No 270; 7-18, 30-43 and 4-12 of Seq ID No 271; 4-30, 39-47 and 5-22 of Seq ID No 272; 6-15 and 14-29 of Seq ID No 273; 4-34 and 23-35 of Seq ID No 274; 4-36, 44-57, 65-72 and 14-27 of Seq ID No 275; 4-18 and 11-20 of Seq ID No 276; 5-19 of Seq ID No 277; 18-36 and 6-20 of Seq ID No 278; 4-10, 19-34, 41-84, 96-104 and 50-63 of Seq ID No 279; 4-9, 19-27 and 8-21 of Seq ID No 280; 4-16, 18-28 and 22-30 of Seq ID No 281; 4-15 and 21-35 of Seq ID No 282; 4-17 and 3-13 of Seq ID No 283; 4-12 and 4-18 of Seq ID No 284; 4-24, 31-36 and 29-45 of Seq ID No 285; 12-22, 34-49 and 21-32 of Seq ID No 286; 4-17 and 22-32 of Seq ID No 287; 4-16, 25-42 and 7-28 of Seq ID No 288; 4-10 and 7-20 of Seq ID No 289; 4-11, 16-36, 39-54 and 28-44 of Seq ID No 290; 5-20, 29-54 and 14-29 of Seq ID No 291; 24-33 and 10-22 of Seq ID No 292; 10-51, 54-61 and 43-64 of Seq ID No 293; 7-13 and 2-17 of Seq ID No 294; 11-20 and 6-20 of Seq ID No 295; 4-30, 34-41 and 19-28 of Seq ID No 296; 11-21 of Seq ID No 297; 4-16, 21-26 and 9-38 of Seq ID No 298; 4-12, 15-27, 30-42, 66-72 and 10-24 of Seq ID No 299; 8-17 and 11-20 of Seq ID No 300; and 2-19 of Seq ID No246; 1-12 of Seq ID No 247; 21-38 of Seq ID No 248; 2-22 of Seq ID No 254; 15-33 of Seq ID No 255; 11-32 of Seq ID No 256; 11-28 of Seq ID No 259; 10-27 of Seq ID No 260; 9-26 of Seq ID No 261; 4-16 of Seq ID No 263; 1-18 of Seq ID No 266; 12-29 of Seq ID No 273; 6-23 of Seq ID No 276; 1-21 of Seq ID No 277; 47-64 of Seq ID No 279; 28-45 of Seq ID No 285; 18-35 of Seq ID No 287; 14-31 of Seq ID No 291; 7-24 of Seq ID No 292; 8-25 of Seq ID No 299; 1-20 of Seq ID No 300; 18-33 of Seq ID No 151; 62-72 of Seq ID No 151; 118-131 of Seq ID No 152; 195-220 of Seq ID No 154; 215-240 of Seq ID No 154; 255-280 of Seq ID No 154, 72-81 of Seq ID No 155; 174-186 of Seq ID No 156; 317-331 of Seq ID No 157; 35-59 of Seq ID No 158; 54-84 of Seq ID No 158; 79-104 of Seq ID No 158; 33-58 of Seq ID No 159; 81-101 of Seq ID No 159; 136-150 of Seq ID No 159; 173-186 of Seq ID No 159; 231-251 of Seq ID No 159; 22-48 of Seq ID No 161; 24-39 of Seq ID No 162; 475-489 of Seq ID No 163; 38-56 of Seq ID No 164; 583-604 of Seq ID No 164; 202-223 of Seq ID No 165; 222-247 of Seq ID No 165; 242-267 of Seq ID No 165; 262-287 of Seq ID No 165; 282-307 of Seq ID No 165; 302-327 of Seq ID No 165; 25-48 of Seq ID No 166; 204-217 of Seq ID No 167; 259-276 of Seq ID No 168; 121-139 of Seq ID No 169; 260-267 of Seq ID No 169; 215-240 of Seq ID No 169; 115-140 of Seq ID No 170; 182-204 of Seq ID No 172; 144-153 of Seq ID No 173; 205-219 of Seq ID No 173; 196-206 of Seq ID No 174; 240-249 of Seq ID No 174; 272-287 of Seq ID No 174; 199-223 of Seq ID No 174; 218-237 of Seq ID No 174; 226-249 of Seq ID No 175; 287-306 of Seq ID No 175; 430-449 of Seq ID No 176; 361-375 of Seq ID No 177; 241-260 of Seq ID No 178; 483-502 of Seq ID No 181; 379-396 of Seq ID No 182; 31-51 of Seq ID No 184; 1436-1460 of Seq ID No 186; 1455-1474 of Seq ID No 186; 1469-1487 of Seq ID No 186; 215-229 of Seq ID No 187; 534-561 of Seq ID No 187; 59-84 of Seq ID No 187; 79-104 of Seq ID No 187; 618-635 of Seq ID No 188; 191-203 of Seq ID No 189; 386-398 of Seq ID No 190; 65-83 of Seq ID No 191; 90-105 of Seq ID No 192; 112-136 of Seq ID No 192; 290-209 of Seq ID No 193; 33-50 of Seq ID No 194; 76-90 of Seq ID No 195; 70-88 of Seq ID No 196; 418-442 of Seq ID No 197; 574-585 of Seq ID No 197; 87-104 of Seq ID No 198; 124-148 of Seq ID No 198; 141-152 of Seq ID No 198; 241-248 of Seq ID No 199; 183-198 of Seq ID No 200; 40-57 of Seq ID No 201; 202-217 of Seq ID No 202; 50-74 of Seq ID No 203; 69-93 of Seq ID No 203; 88-112 of Seq ID No 203; 107-127 of Seq ID No 203; 74-92 of Seq ID No 205; 207-232 of Seq ID No 206; 227-252 of Seq ID No 206; 247-272 of Seq ID No 206; 47-60 of Seq ID No 207; 297-305 of Seq ID No 207; 312-337 of Seq ID No 207; 667-384 of Seq ID No 208; 279-295 of Seq ID No 210; 179-198 of Seq ID No 211; 27-51 of Seq ID No 213; 46-70 of Seq ID No 213; 65-89 of Seq ID No 213; 84-108 of Seq ID No 213; 112-141 of Seq ID No 213; 248-260 of Seq ID No 215; 59-78 of Seq ID No 216; 154-170 of Seq ID No 218; 57-73 of Seq ID No 219; 297-314 of Seq ID No 220; 142-157 of Seq ID No 221; 428-447 of Seq ID No 222; 573-593 of Seq ID No 222; 523-544 of Seq ID No 223; 46-70 of Seq ID No 223; 65-89 of Seq ID No 223; 84-108 of Seq ID No 223; 122-151 of Seq ID No 223; 123-142 of Seq ID No 224; 903-921 of Seq ID No 225; 119-136 of Seq ID No 226; 142-161 of Seq ID No 227; 258-277 of Seq ID No 228; 272-300 of Seq ID No 228; 295-322 of Seq ID No 228; 311-343 of Seq ID No 229; 278-304 of Seq ID No 229; 131-150 of Seq ID No 230; 195-218 of Seq ID No 230; 53-70 of Seq ID No 231; 184-208 of Seq ID No 232; 222-246 of Seq ID No 232; 241-265 of Seq ID No 232; 260-284 of Seq ID No 232; 279-303 of Seq ID No 232; 317-341 of Seq ID No 232; 678-696 of Seq ID No 233; 88-114 of Seq ID No 235; 464481 of Seq ID No 235; 153-172 of Seq ID No 236; 137-155,166-184 of Seq ID No 236; 215-228 of Seq ID No 236; 37-51 of Seq ID No 237; 53-75 of Seq ID No 237; 232-251 of Seq ID No 237; 318-336 of Seq ID No 237; 305-315 of Seq ID No 238; 131-156 of Seq ID No 238; 258-275 of Seq ID No 241; 107-137 of Seq ID No 243; 138-162 of Seq ID No 243; 157-181 of Seq ID No 243; 195-227 of Seq ID No 243; 62-78 of Seq ID No 244; 567-584 of Seq ID No 245, and fragments comprising at least 6, preferably more than 8, especially more than 10 aa of said sequences. All these fragments individually and each independently form a preferred selected aspect of the present invention.

All linear hyperimmune serum reactive fragments of a particular antigen may be identified by analysing the entire sequence of the protein antigen by a set of peptides overlapping by 1 amino acid with a length of at least 10 amino acids. Subsequently, non-linear epitopes can be identified by analysis of the protein antigen with hyperimmune sera using the expressed full-length protein or domain polypeptides thereof. Assuming that a distinct domain of a protein is sufficient to form the 3D structure independent from the native protein, the analysis of the respective recombinant or synthetically produced domain polypeptide with hyperimmune serum would allow the identification of conformational epitopes within the individual domains of multi-domain proteins. For those antigens where a domain possesses linear as well as conformational epitopes, competition experiments with peptides corresponding to the linear epitopes may be used to confirm the presence of conformational epitopes.

It will be appreciated that the invention also relates to, among others, nucleic acid molecules encoding the aforementioned fragments, nucleic acid molecules that hybridise to nucleic acid molecules encoding the fragments, particularly those that hybridise under stringent conditions, and nucleic acid molecules, such as PCR primers, for amplifying nucleic acid molecules that encode the fragments. In these regards, preferred nucleic acid molecules are those that correspond to the preferred fragments, as discussed above.

The present invention also relates to vectors which comprise a nucleic acid molecule or nucleic acid molecules of the present invention, host cells which are genetically engineered with vectors of the invention and the production of hyperimmune serum reactive antigens and fragments thereof by recombinant techniques.

A great variety of expression vectors can be used to express a hyperimmune serum reactive antigen or fragment thereof according to the present invention. Generally, any vector suitable to maintain, propagate or express nucleic acids to express a polypeptide in a host may be used for expression in this regard. In accordance with this aspect of the invention the vector may be, for example, a plasmid vector, a single or double-stranded phage vector, a single or double-stranded RNA or DNA viral vector. Starting plasmids disclosed herein are either commercially available, publicly available, or can be constructed from available plasmids by routine application of well-known, published procedures. Preferred among vectors, in certain respects, are those for expression of nucleic acid molecules and hyperimmune serum reactive antigens or fragments thereof of the present invention. Nucleic acid constructs in host cells can be used in a conventional manner to produce the gene product encoded by the recombinant sequence. Alternatively, the hyperimmune serum reactive antigens and fragments thereof of the invention can be synthetically produced by conventional peptide synthesizers. Mature proteins can be expressed in mammalian cells, yeast, bacteria, or other cells under the control of appropriate promoters. Cell-free translation systems can also be employed to produce such proteins using RNAs derived from the DNA construct of the present invention.

Host cells can be genetically engineered to incorporate nucleic acid molecules and express nucleic acid molecules of the present invention. Representative examples of appropriate hosts include bacterial cells, such as *streptococci*, *staphylococci*, *E. coli*, *Streptomyces* and *Bacillus subtillis* cells; fungal cells, such as yeast cells and *Aspergillus* cells; insect cells such as Drosophila S2 and Spodoptera Sf9 cells; animal cells such as CHO, COS, Hela, C127, 3T3, BHK, 293 and Bowes melanoma cells; and plant cells.

The invention also provides a process for producing a *S. pyogenes* hyperimmune serum reactive antigen and a fragment thereof comprising expressing from the host cell a hyperimmune serum reactive antigen or fragment thereof encoded by the nucleic acid molecules provided by the present invention. The invention further provides a process for producing a cell, which expresses a *S. pyogenes* hyperimmune serum reactive antigen or a fragment thereof comprising transforming or transfecting a suitable host cell with the vector according to the present invention such that the transformed or transfected cell expresses the polypeptide encoded by the nucleic add contained in the vector.

The polypeptide may be expressed in a modified form, such as a fusion protein, and may include not only secretion signals but also additional heterologous functional regions. Thus, for instance, a region of additional amino adds, particularly charged amino adds, may be added to the N- or C-terminus of the polypeptide to improve stability and persistence in the host cell, during purification or during subsequent handling and storage. Also, regions may be added to the polypeptide to facilitate purification. Such regions may be removed prior to final preparation of the polypeptide. The addition of peptide moieties to polypeptides to engender secretion or excretion, to improve stability or to facilitate purification, among others, are familiar and routine techniques in the art. A preferred fusion protein comprises a heterologous region from immunoglobulin that is useful to solubilize or purify polypeptides. For example, EP-A-O 464 533 (Canadian counterpart 2045869) discloses fusion proteins comprising various portions of constant region of immunoglobin molecules together with another protein or part thereof. In drug discovery, for example, proteins have been fused with antibody Fc portions for the purpose of high-throughout screening assays to identify antagonists. See for example, {Bennett, D. et al., 1995} and {Johanson, K. et al., 1995}.

The *S. pyogenes* hyperimmune serum reactive antigen or a fragment thereof can be recovered and purified from recombinant cell cultures by well-known methods including ammonium sulfate or ethanol precipitation, add extraction, anion or cation exchange chromatography, phosphocellulose chromatography, hydrophobic interaction chromatography, hydroxylapatite chromatography and lectin chromatography.

The hyperimmune serum reactive antigens and fragments thereof according to the present invention can be produced by chemical synthesis as well as by biotechnological means. The latter comprise the transfection or transformation of a host cell with a vector containing a nucleic acid according to the present invention and the cultivation of the transfected or transformed host cell under conditions which are known to the ones skilled in the art. The production method may also comprise a purification step in order to purify or isolate the polypeptide to be manufactured. In a preferred embodiment the vector is a vector according to the present invention.

The hyperimmune serum reactive antigens and fragments thereof according to the present invention may be used for the detection of the organism or organisms in a sample containing these organisms or polypeptides derived thereof. Preferably such detection is for diagnosis, more preferable for the diagnosis of a disease, most preferably for the diagnosis of a diseases related or linked to the presence or abundance of Gram-positive bacteria, especially bacteria selected from the group comprising *streptococci, staphylococci* and *lactococci*. More preferably, the microorganisms are selected from the group comprising *Streptococcus agalactiae, Streptococcus pneumoniae* and *Streptococcus mutans*, especially the microorganism is *Streptococcus pyogenes*.

The present invention also relates to diagnostic assays such as quantitative and diagnostic assays for detecting levels of the hyperimmune serum reactive antigens and fragments thereof of the present invention in cells and tissues, including determination of normal and abnormal levels. Thus, for instance, a diagnostic assay in accordance with the invention for detecting over-expression of the polypeptide compared to normal control tissue samples may be used to detect the presence of an infection, for example, and to identify the infecting organism. Assay techniques that can be used to determine levels of a polypeptide, in a sample derived from a host are well-known to those of skill in the art. Such assay methods include radioimmunoassays, competitive-binding assays, Western Blot analysis and ELISA assays. Among these, ELISAs frequently are preferred. An ELISA assay initially comprises preparing an antibody specific to the polypeptide, preferably a monoclonal antibody. In addition, a reporter antibody generally is prepared which binds to the monoclonal antibody. The reporter antibody is attached to a detectable reagent such as radioactive, fluorescent or enzymatic reagent, such as horseradish peroxidase enzyme.

The hyperimmune serum reactive antigens and fragments thereof according to the present invention may also be used for the purpose of or in connection with an array. More particularly, at least one of the hyperimmune serum reactive antigens and fragments thereof according to the present invention may be immobilized on a support. Said support typically comprises a variety of hyperimmune serum reactive antigens and fragments thereof whereby the variety may be created by using one or several of the hyperimmune serum reactive antigens and fragments thereof according to the present invention and/or hyperimmune serum reactive antigens and fragments thereof being different. The characterizing feature of such array as well as of any array in general is the fact that at a distinct or predefined region or position on said support or a surface thereof, a distinct polypeptide is immobilized. Because of this any activity at a distinct position or region of an array can be correlated with a specific polypeptide. The number of different hyperimmune serum reactive antigens and fragments thereof immobilized on a support may range from as little as 10 to several 1000 different hyperimmune serum reactive antigens and fragments thereof. The density of hyperimmune serum reactive antigens and fragments thereof per $cm^2$ is in a preferred embodiment as little as 10 peptides/polypeptides per $cm^2$ to at least 400 different peptides/polypeptides per $cm^2$ and more particularly at least 1000 different hyperimmune serum reactive antigens and fragments thereof per $cm^2$.

The manufacture of such arrays is known to the one skilled in the art and, for example, described in U.S. Pat. No. 5,744,309. The array preferably comprises a planar, porous or non-porous solid support having at least a first surface. The hyperimmune serum reactive antigens and fragments thereof as disclosed herein, are immobilized on said surface. Preferred support materials are, among others, glass or cellulose. It is also within the present invention that the array is used for any of the diagnostic applications described herein. Apart from the hyperimmune serum reactive antigens and fragments thereof according to the present invention also the nucleic acid molecules according to the present invention may be used for the generation of an array as described above. This applies as well to an array made of antibodies, preferably monoclonal antibodies as, among others, described herein.

In a further aspect the present invention relates to an antibody directed to any of the hyperimmune serum reactive antigens and fragments thereof, derivatives or fragments thereof according to the present invention. The present invention includes, for example, monoclonal and polyclonal antibodies, chimeric, single chain, and humanized antibodies, as well as Fab fragments, or the product of a Fab expression library. It is within the present invention that the antibody may be chimeric, i.e. that different parts thereof stem from different species or at least the respective sequences are taken from different species.

Antibodies generated against the hyperimmune serum reactive antigens and fragments thereof corresponding to a sequence of the present invention can be obtained by direct injection of the hyperimmune serum reactive antigens and fragments thereof into an animal or by administering the hyperimmune serum reactive antigens and fragments thereof to an animal, preferably a non-human. The antibody so obtained will then bind the hyperimmune serum reactive antigens and fragments thereof itself. In this manner, even a sequence encoding only a fragment of a hyperimmune serum reactive antigen and fragments thereof can be used to generate antibodies binding the whole native hyperimmune serum reactive antigen and fragments thereof. Such antibodies can then be used to isolate the hyperimmune serum reactive antigens and fragments thereof from tissue expressing those hyperimmune serum reactive antigens and fragments thereof.

For preparation of monoclonal antibodies, any technique known in the art which provides antibodies produced by continuous cell line cultures can be used. (as described originally in {Kohler, G. et al., 1975}.

Techniques described for the production of single chain antibodies (U.S. Pat. No. 4,946,778) can be adapted to produce single chain antibodies to immunogenic hyperimmune serum reactive antigens and fragments thereof according to this invention. Also, transgenic mice, or other organisms such as other mammals, may be used to express humanized antibodies to immunogenic hyperimmune serum reactive antigens and fragments thereof according to this invention.

Alternatively, phage display technology or ribosomal display could be utilized to select antibody genes with binding activities towards the hyperimmune serum reactive antigens and fragments thereof either from repertoires of PCR amplified v-genes of lymphocytes from humans screened for possessing respective target antigens or from naïve libraries {McCafferty, J. et al., 1990}; {Marks, J. et al., 1992}. The affinity of these antibodies can also be improved by chain shuffling {Clackson, T. et al., 1991}.

If two antigen binding domains are present, each domain may be directed against a different epitope—termed 'bispecific' antibodies.

The above-described antibodies may be employed to isolate or to identify clones expressing the hyperimmune serum reactive antigens and fragments thereof or purify the hyperimmune serum reactive antigens and fragments thereof of the present invention by attachment of the antibody to a solid support for isolation and/or purification by affinity chromatography.

Thus, among others, antibodies against the hyperimmune serum reactive antigens and fragments thereof of the present invention may be employed to inhibit and/or treat infections, particularly bacterial infections and especially infections arising from S. pyogenes.

Hyperimmune serum reactive antigens and fragments thereof include antigenically, epitopically or immunologically equivalent derivatives which form a particular aspect of this invention. The term "antigenically equivalent derivative" as used herein encompasses a hyperimmune serum reactive antigen and fragments thereof or its equivalent which will be specifically recognized by certain antibodies which, when raised to the protein or hyperimmune serum reactive antigen and fragments thereof according to the present invention, interfere with the interaction between pathogen and mammalian host. The term "immunologically equivalent derivative" as used herein encompasses a peptide or its equivalent which when used in a suitable formulation to raise antibodies in a vertebrate, the antibodies act to interfere with the interaction between pathogen and mammalian host.

The hyperimmune serum reactive antigens and fragments thereof, such as an antigenically or immunologically equivalent derivative or a fusion protein thereof can be used as an antigen to immunize a mouse or other animal such as a rat or chicken. The fusion protein may provide stability to the hyperimmune serum reactive antigens and fragments thereof. The antigen may be associated, for example by conjugation, with an immunogenic carrier protein, for example bovine serum albumin (BSA) or keyhole limpet haemocyanin (KLH). Alternatively, an antigenic peptide comprising multiple copies of the protein or hyperimmune serum reactive antigen and fragments thereof, or an antigenically or immunologically equivalent hyperimmune serum reactive antigen and fragments thereof, may be sufficiently antigenic to improve immunogenicity so as to obviate the use of a carrier.

Preferably the antibody or derivative thereof is modified to make it less immunogenic in the individual. For example, if the individual is human the antibody may most preferably be "humanized", wherein the complimentarily determining region(s) of the hybridoma-derived antibody has been transplanted into a human monoclonal antibody, for example as described in {Jones, P. et al., 1986} or {Tempest, P. et al., 1991}.

The use of a polynucleotide of the invention in genetic immunization will preferably employ a suitable delivery method such as direct injection of plasmid DNA into muscle, delivery of DNA complexed with specific protein carriers, coprecipitation of DNA with calcium phosphate, encapsulation of DNA in various forms of liposomes, particle bombardment {Tang, D. et al., 1992}, {Eisenbraun, M. et al., 1993} and in vivo infection using cloned retroviral vectors {Seeger, C. et al., 1984}.

In a further aspect the present invention relates to a peptide binding to any of the hyperimmune serum reactive antigens and fragments thereof according to the present invention, and a method for the manufacture of such peptides whereby the method is characterized by the use of the hyperimmune serum reactive antigens and fragments thereof according to the present invention and the basic steps are known to the one skilled in the art.

Such peptides may be generated by using methods according to the state of the art such as phage display or ribosome display. In case of phage display, basically a library of peptides is generated, in form of phages, and this kind of library is contacted with the target molecule, in the present case a hyperimmune serum reactive antigen and fragments thereof according to the present invention. Those peptides binding to the target molecule are subsequently removed, preferably as a complex with the target molecule, from the respective reaction. It is known to the one skilled in the art that the binding characteristics, at least to a certain extent, depend on the particularly realized experimental set-up such as the salt concentration and the like. After separating those peptides binding to the target molecule with a higher affinity or a bigger force, from the non-binding members of the library, and optionally also after removal of the target molecule from the complex of target molecule and peptide, the respective peptide(s) may subsequently be characterised. Prior to the characterisation optionally an amplification step is realized such as, e. g. by propagating the peptide coding phages. The characterisation preferably comprises the sequencing of the target binding peptides. Basically, the peptides are not limited in their lengths, however, preferably peptides having a lengths from about 8 to 20 amino adds are preferably obtained in the respective methods. The size of the libraries may be about $10^2$ to $10^{18}$, preferably $10^8$ to $10^{15}$ different peptides, however, is not limited thereto.

A particular form of target binding hyperimmune serum reactive antigens and fragments thereof are the so-called "anticalines" which are, among others, described in German patent application DE 197 42 706.

In a further aspect the present invention relates to functional nucleic acids interacting with any of the hyperimmune serum reactive antigens and fragments thereof according to the present invention, and a method for the manufacture of such functional nucleic adds whereby the method is characterized by the use of the hyperimmune serum reactive antigens and fragments thereof according to the present invention and the basic steps are known to the one skilled in the art. The functional nucleic acids are preferably aptamers and spiegelmers.

Aptamers are D-nucleic acids which are either single stranded or double stranded and which specifically interact with a target molecule. The manufacture or selection of aptamers is, e. g., described in European patent EP 0 533 838. Basically the following steps are realized. First, a mixture of nucleic acids, i. e. potential aptamers, is provided whereby each nucleic acid typically comprises a segment of several, preferably at least eight subsequent randomised nucleotides. This mixture is subsequently contacted with the target molecule whereby the nucleic acid(s) bind to the target molecule, such as based on an increased affinity towards the target or with a bigger force thereto, compared to the candidate mixture. The binding nucleic acid(s) are/is subsequently separated from the remainder of the mixture. Optionally, the thus obtained nucleic acid(s) is amplified using, e.g. polymerase chain reaction. These steps may be repeated several times giving at the end a mixture having an increased ratio of nucleic acids specifically binding to the target from which the final binding nucleic acid is then optionally selected. These specifically binding nucleic acid(s) are referred to aptamers. It is obvious that at any stage of the method for the generation or identification of the aptamers samples of the mixture of individual nucleic acids may be taken to determine the sequence thereof using standard techniques. It is within the present invention that the aptamers may be stabilized such as, e. g., by introducing defined chemical groups which are known to the one skilled in the art of generating aptamers. Such modification may for example reside in the introduction of an amino group at the 2'-position of the sugar moiety of the nucleotides. Aptamers are currently used as therapeutical agens. However, it is also within the present invention that the thus selected or generated aptamers may be used for target validation and/or as lead substance for the development of medicaments, preferably of medicaments based on small molecules. This is actually done by a competition assay whereby the specific interaction between the target molecule and the aptamer is inhibited by a candidate drug whereby upon replacement of the aptamer from the complex of target and aptamer it may be assumed that the respective drug candidate allows a specific inhibition of the interaction between target and aptamer, and if the interaction is specific, said candidate drug will, at least in principle, be suitable to block the target and thus decrease its biological availability or activity in a respective system comprising such target. The thus obtained small molecule may then be subject to further derivatisation and modification to optimise its physical, chemical, biological and/or medical characteristics such as toxicity, specificity, biodegradability and bioavailability.

Spiegelmers and their generation or manufacture is based on a similar principle. The manufacture of spiegelmers is described in international patent application WO 98/08856. Spiegelmers are L-nucleic acids, which means that they are composed of L-nucleotides rather than D-nucleotides as aptamers are. Spiegelmers are characterized by the fact that they have a very high stability in biological system and, comparable to aptamers, specifically interact with the target molecule against which they are directed. In the process of generating spiegelmers, a heterogonous population of D-nucleic acids is created and this population is contacted with the optical antipode of the target molecule, in the present case for example with the D-enantiomer of the naturally occurring L-enantiomer of the hyperimmune serum reactive antigens and fragments thereof according to the present invention. Subsequently, those D-nucleic acids are separated which do not interact with the optical antipode of the target molecule. But those D-nucleic acids interacting with the optical antipode of the target molecule are separated, optionally determined and/or sequenced and subsequently the corresponding L-nucleic acids are synthesized based on the nucleic acid sequence information obtained from the D-nucleic acids. These L-nucleic acids which are identical in terms of sequence with the aforementioned D-nucleic acids interacting with the optical antipode of the target molecule, will specifically interact with the naturally occurring target molecule rather than with the optical antipode thereof. Similar to the method for the generation of aptamers it is also possible to repeat the various steps several times and thus to enrich those nucleic acids specifically interacting with the optical antipode of the target molecule.

In a further aspect the present invention relates to functional nucleic acids interacting with any of the nucleic acid molecules according to the present invention, and a method for the manufacture of such functional nucleic acids whereby the method is characterized by the use of the nucleic acid molecules and their respective sequences according to the present invention and the basic steps are known to the one skilled in the art. The functional nucleic acids are preferably ribozymes, antisense oligonucleotides and siRNA.

Ribozymes are catalytically active nucleic acids which preferably consist of RNA which basically comprises two moieties. The first moiety shows a catalytic activity whereas the second moiety is responsible for the specific interaction with the target nucleic acid, in the present case the nucleic acid coding for the hyperimmune serum reactive antigens and fragments thereof according to the present invention. Upon interaction between the target nucleic acid and the second moiety of the ribozyme, typically by hybridisation and Watson-Crick base pairing of essentially complementary stretches of bases on the two hybridising strands, the catalytically active moiety may become active which means that it catalyses, either intramolecularly or intermolecularly, the target nucleic acid in case the catalytic activity of the ribozyme is a phosphodiesterase activity. Subsequently, there may be a further degradation of the target nucleic acid which in the end results in the degradation of the target nucleic acid as well as the protein derived from the said target nucleic acid. Ribozymes, their use and design principles are known to the one skilled in the art, and, for example described in {Doherty, E. et al., 2001} and {Lewin, A. et al., 2001}.

The activity and design of antisense oligonudeotides for the manufacture of a medicament and as a diagnostic agent, respectively, is based on a similar mode of action. Basically, antisense oligonudeotides hybridise based on base complementarity, with a target RNA, preferably with a mRNA, thereby activate RNase H. RNase H is activated by both phosphodiester and phosphorothioate-coupled DNA. Phosphodiester-coupled DNA, however, is rapidly degraded by cellular nucleases with the exception of phosphorothioate-coupled DNA. These resistant, non-naturally occurring DNA derivatives do not inhibit RNase H upon hybridisation with RNA. In other words, antisense polynucleotides are only effective as DNA RNA hybride complexes. Examples for this kind of antisense oligonudeotides are described, among others, in U.S. Pat. Nos. 5,849,902 and 5,989,912. In other words, based on the nucleic add sequence of the target molecule which in the present case are the nucleic acid molecules for the hyperimmune serum reactive antigens and fragments thereof according to the present invention, either from the target protein from which a respective nucleic add sequence may in principle be deduced, or by knowing the nucleic add sequence as such, particularly the mRNA, suitable antisense oligonudeotides may be designed base on the principle of base complementarity.

Particularly preferred are antisense-oligonudeotides which have a short stretch of phosphorothioate DNA (3 to 9 bases). A minimum of 3 DNA bases is required for activation of bacterial RNase H and a minimum of 5 bases is required for mammalian RNase H activation. In these chimeric oligonucleotides there is a central region that forms a substrate for RNase H that is flanked by hybridising "arms" comprised of modified nucleotides that do not form substrates for RNase H. The hybridising arms of the chimeric oligonucleotides may be modified such as by 2'-O-methyl or 2'-fluoro. Alternative approaches used methylphosphonate or phosphoramidate linkages in said arms. Further embodiments of the antisense oligonudeotide useful in the practice of the present invention are P-methoxyoligonucleotides, partial P-methoxyoligodeoxyribonucleotides or P-methoxyoligonucleotides.

Of particular relevance and usefulness for the present invention are those antisense oligonucleotides as more particularly described in the above two mentioned US patents. These oligonucleotides contain no naturally occurring 5'→3'-linked nucleotides. Rather the oligonucdeotides have two types of nucleotides: 2'-deoxyphosphorothioate, which activate RNase H, and 2'-modified nucleotides, which do not. The linkages between the 2'-modified nucleotides can be phosphodiesters, phosphorothioate or P-ethoxyphosphodiester. Activation of RNase H is accomplished by a contiguous RNase H-activating region, which contains between 3 and 5 2'-deoxyphosphorothioate nucleotides to activate bacterial RNase H and between 5 and 10 2'-deoxyphosphorothioate nucleotides to activate eucaryotic and, particularly, mammalian RNase H. Protection from degradation is accomplished by making the 5' and 3' terminal bases highly nuclease resistant and, optionally, by placing a 3' terminal blocking group.

More particularly, the antisense oligonucleotide comprises a 5' terminus and a 3' terminus; and from 11 to 59 5'→3'-linked nucleotides independently selected from the group consisting of 2'-modified phosphodiester nucleotides and 2'-modified P-alkyloxyphosphotriester nucleotides; and wherein the 5'-terminal nucleoside is attached to an RNase H-activating region of between three and ten contiguous phosphorothioate-linked deoxyribonucleotides, and wherein the 3'-terminus of said oligonucleotide is selected from the group consisting of an inverted deoxyribonucleotides, a contiguous stretch of one to three phosphorothioate 2'-modified ribonucleotides, a biotin group and a P-alkyloxyphosphotriester nucleotide.

Also an antisense oligonudeotide may be used wherein not the 5'terminal nucleoside is attached to an RNase H-activating region but the 3' terminal nucleoside as specified above. Also, the 5' terminus is selected from the particular group rather than the 3' terminus of said oligonucleotide.

The nucleic adds as well as the hyperimmune serum reactive antigens and fragments thereof according to the present invention may be used as or for the manufacture of pharmaceutical compositions, especially vaccines. Preferably such pharmaceutical composition, preferably vaccine is for the prevention or treatment of diseases caused by, related to or associated with *S. pyogenes*. In so far another aspect of the invention relates to a method for inducing an immunological response in an individual, particularly a mammal, which comprises inoculating the individual with the hyperimmune serum reactive antigens and fragments thereof of the invention, or a fragment or variant thereof, adequate to produce antibodies to protect said individual from infection, particularly *Streptococcus* infection and most particularly *S. pyogenes* infections.

Yet another aspect of the invention relates to a method of inducing an immunological response in an individual which comprises, through gene therapy or otherwise, delivering a nucleic acid functionally encoding hyperimmune serum reactive antigens and fragments thereof, or a fragment or a variant thereof, for expressing the hyperimmune serum reactive antigens and fragments thereof, or a fragment or a variant thereof in vivo in order to induce an immunological response to produce antibodies or a cell mediated T cell response, either cytokine-producing T cells or cytotoxic T cells, to protect said individual from disease, whether that disease is already established within the individual or not. One way of administering the gene is by accelerating it into the desired cells as a coating on particles or otherwise.

A further aspect of the invention relates to an immunological composition which, when introduced into a host capable of having induced within it an immunological response, induces an immunological response in such host, wherein the composition comprises recombinant DNA which codes for and expresses an antigen of the hyperimmune serum reactive antigens and fragments thereof of the present invention. The immunological response may be used therapeutically or prophylactically and may take the form of antibody immunity or cellular immunity such as that arising from CTL or CD4+ T cells.

The hyperimmune serum reactive antigens and fragments thereof of the invention or a fragment thereof may be fused with a co-protein which may not by itself produce antibodies, but is capable of stabilizing the first protein and producing a fused protein which will have immunogenic and protective properties. This fused recombinant protein preferably further comprises an antigenic co-protein, such as Glutathione-S-transferase (GST) or beta-galactosidase, relatively large co-proteins which solubilise the protein and facilitate production and purification thereof. Moreover, the co-protein may act as an adjuvant in the sense of providing a generalized stimulation of the immune system. The co-protein may be attached to either the amino or carboxy terminus of the first protein.

Also, provided by this invention are methods using the described nucleic acid molecule or particular fragments thereof in such genetic immunization experiments in animal models of infection with *S. pyogenes*. Such fragments will be particularly useful for identifying protein epitopes able to provoke a prophylactic or therapeutic immune response. This approach can allow for the subsequent preparation of monoclonal antibodies of particular value from the requisite organ of the animal successfully resisting or clearing infection for the development of prophylactic agents or therapeutic treatments of *S. pyogenes* infection in mammals, particularly humans.

The hyperimmune serum reactive antigens and fragments thereof may be used as an antigen for vaccination of a host to produce specific antibodies which protect against invasion of bacteria, for example by blocking adherence of bacteria to damaged tissue. Examples of tissue damage include wounds in skin or connective tissue caused e.g. by mechanical, chemical or thermal damage or by implantation of indwelling devices, or wounds in the mucous membranes, such as the mouth, mammary glands, urethra or vagina.

The present invention also includes a vaccine formulation which comprises the immunogenic recombinant protein together with a suitable carrier. Since the protein may be broken down in the stomach, it is preferably administered parenterally, including, for example, administration that is subcutaneous, intramuscular, intravenous, or intradermal. Formulations suitable for parenteral administration include aqueous and non-aqueous sterile injection solutions which may contain anti-oxidants, buffers, bacteriostats and solutes which render the formulation isotonic with the bodily fluid, preferably the blood, of the individual; and aqueous and non-aqueous sterile suspensions which may include suspending agents or thickening agents. The formulations may be presented in unit-dose or multi-dose containers, for example, sealed ampoules and vials, and may be stored in a freeze-dried condition requiring only the addition of the sterile liquid carrier immediately prior to use. The vaccine formulation may also include adjuvant systems for enhancing the immunogenicity of the formulation, such as oil-in-water systems and other systems known in the art. The dosage will depend on the specific activity of the vaccine and can be readily determined by routine experimentation.

According to another aspect, the present invention relates to a pharmaceutical composition comprising such a hyperimmune serum-reactive antigen or a fragment thereof as provided in the present invention for *S. pyogenes*. Such a pharmaceutical composition may comprise one or more hyperimmune serum reactive antigens or fragments thereof against *S. pyogenes*. Optionally, such *S. pyogenes* hyperimmune serum reactive antigens or fragments thereof may also be combined with antigens against other pathogens in a combination pharmaceutical composition. Preferably, said pharmaceutical composition is a vaccine for preventing or treating an infection caused by *S. pyogenes* and/or other pathogens against which the antigens have been included in the vaccine.

According to a further aspect, the present invention relates to a pharmaceutical composition comprising a nucleic acid molecule encoding a hyperimmune serum-reactive antigen or a fragment thereof as identified above for *S. pyogenes*. Such a pharmaceutical composition may comprise one or more nucleic acid molecules encoding hyperimmune serum reactive antigens or fragments thereof against *S. pyogenes*. Optionally, such *S. pyogenes* nucleic acid molecules encoding hyperimmune serum reactive antigens or fragments thereof may also be combined with nucleic acid molecules encoding antigens against other pathogens in a combination pharmaceutical composition. Preferably, said pharmaceutical composition is a vaccine for preventing or treating an infection caused by *S. pyogenes* and/or other pathogens against which the antigens have been included in the vaccine.

The pharmaceutical composition may contain any suitable auxiliary substances, such as buffer substances, stabilisers or further active ingredients, especially ingredients known in connection of pharmaceutical composition and/or vaccine production.

A preferable carrier/or excipient for the hyperimmune serum-reactive antigens, fragments thereof or a coding nucleic acid molecule thereof according to the present invention is an immunostimulatory compound for further stimulating the immune response to the given hyperimmune serum-reactive antigen, fragment thereof or a coding nucleic acid molecule thereof. Preferably the immunostimulatory compound in the pharmaceutical preparation according to the present invention is selected from the group of polycationic substances, especially polycationic peptides, immunostimulatory nucleic acids molecules, preferably immunostimulatory deoxynucleotides, alum, Freund's complete adjuvants, Freund's incomplete adjuvants, neuroactive compounds, especially human growth hormone, or combinations thereof.

It is also within the scope of the present invention that the pharmaceutical composition, especially vaccine, comprises apart from the hyperimmune serum reactive antigens, fragments thereof and/or coding nucleic acid molecules thereof according to the present invention other compounds which are biologically or pharmaceutically active. Preferably, the vaccine composition comprises at least one polycationic peptide. The polycationic compound(s) to be used according to the present invention may be any polycationic compound which shows the characteristic effects according to the WO 97/30721. Preferred polycationic compounds are selected from basic polypeptides, organic polycations, basic polyamino acids or mixtures thereof. These polyamino acids should have a chain length of at least 4 amino acid residues (WO 97/30721). Especially preferred are substances like polylysine, polyarginine and polypeptides containing more than 20%, especially more than 50% of basic amino acids in a range of more than 8, especially more than 20, amino acid residues or mixtures thereof. Other preferred polycations and their pharmaceutical compositions are described in WO 97/30721 (e.g. polyethyleneimine) and WO 99/38528. Preferably these polypeptides contain between 20 and 500 amino acid residues, especially between 30 and 200 residues.

These polycationic compounds may be produced chemically or recombinantly or may be derived from natural sources.

Cationic (poly)peptides may also be anti-microbial with properties as reviewed in (Ganz, T., 1999). These (poly)peptides may be of prokaryotic or animal or plant origin or may be produced chemically or recombinantly (WO 02/13857). Peptides may also belong to the class of defensins (WO 02/13857). Sequences of such peptides can be, for example, be found in the Antimicrobial Sequences Database under the internet address of the University of Trieste (bbcm.iniv.trieste.it/!tossi/pag2.html).

Such host defence peptides or defensives are also a preferred form of the polycationic polymer according to the present invention. Generally, a compound allowing as an end product activation (or down-regulation) of the adaptive immune system, preferably mediated by APCs (including dendritic cells) is used as polycationic polymer.

Especially preferred for use as polycationic substances in the present invention are cathelicidin derived antimicrobial peptides or derivatives thereof (International patent application WO 02/13857, incorporated herein by reference), especially antimicrobial peptides derived from mammal cathelicidin, preferably from human, bovine or mouse.

Polycationic compounds derived from natural sources include HIV-REV or HIV-TAT (derived cationic peptides, antennapedia peptides, chitosan or other derivatives of chitin) or other peptides derived from these peptides or proteins by biochemical or recombinant production. Other preferred polycationic compounds are cathelin or related or derived substances from cathelin. For example, mouse cathelin is a peptide which has the amino acid sequence NH$_2$-RLAGLL-RKGGEKIGEKLKUIGQKIKNFFQKLVPQPECOOH (SEQ ID NO: 301). Related or derived cathelin substances contain the whole or parts of the cathelin sequence with at least 15-20 amino acid residues. Derivations may include the substitution or modification of the natural amino acids by amino acids which are not among the 20 standard amino acids. Moreover, further cationic residues may be introduced into such cathelin molecules. These cathelin molecules are preferred to be combined with the antigen. These cathelin molecules surprisingly have turned out to be also effective as an adjuvant for a antigen without the addition of further adjuvants. It is therefore possible to use such cathelin molecules as efficient adjuvants in vaccine formulations with or without further immunactivating substances.

Another preferred polycationic substance to be used according to the present invention is a synthetic peptide containing at least 2 KLK-motifs separated by a linker of 3 to 7 hydrophobic amino acids (International patent application WO 02/32451, incorporated herein by reference).

The pharmaceutical composition of the present invention may further comprise immunostimulatory nucleic acid(s). Immunostimulatory nucleic acids are e. g. neutral or artificial CpG containing nucleic acid, short stretches of nucleic acid derived from non-vertebrates or in form of short oligonucleotides (ODNs) containing non-methylated cytosine-guanine di-nucleotides (CpG) in a certain base context (e.g. described in WO 96/02555). Alternatively, also nucleic acids based on inosine and cytidine as e.g. described in the WO 01/93903, or deoxynucleic acids containing deoxy-inosine and/or deoxy-yuridine residues (described in WO 01/93905 and PCT/EP 02/05448, incorporated herein by reference) may preferably be used as immunostimulatory nucleic acids for the present invention. Preferably, the mixtures of different immunostimulatory nucleic acids may be used according to the present invention.

It is also within the present invention that any of the aforementioned polycationic compounds is combined with any of the immunostimulatory nucleic adds as aforementioned. Preferably, such combinations are according to the ones as described in WO 01/93905, WO 02132451, WO 01/54720, WO 01/93903, WO 02/13857 and PCT/EP 02/05448 and the Austrian patent application A 1924/2001, incorporated herein by reference.

In addition or alternatively such vaccine composition may comprise apart from the hyperimmune serum reactive antigens and fragments thereof, and the coding nucleic acid molecules thereof according to the present invention a neuroactive compound. Preferably, the neuroactive compound is human growth factor as, e.g. described in WO 01/24822. Also preferably, the neuroactive compound is combined with any of the polycationic compounds and/or immunostimulatory nucleic acids as afore-mentioned.

In a further aspect the present invention is related to a pharmaceutical composition. Such pharmaceutical composition is, for example, the vaccine described herein. Also a pharmaceutical composition is a pharmaceutical composition which comprises any of the following compounds or combinations thereof: the nucleic acid molecules according to the present invention, the hyperimmune serum reactive antigens and fragments thereof according to the present invention, the vector according to the present invention, the cells according to the present invention, the antibody according to the present invention, the functional nucleic acids according to the present invention and the binding peptides such as the anticalines according to the present invention, any agonists and antagonists screened as described herein. In connection therewith any of these compounds may be employed in combination with a non-sterile or sterile carrier or carriers for use with cells, tissues or organisms, such as a pharmaceutical carrier suitable for administration to a subject. Such compositions comprise, for instance, a media additive or a therapeutically effective amount of a hyperimmune serum reactive antigen and fragments thereof of the invention and a pharmaceutically acceptable carrier or excipient. Such carriers may include, but are not limited to, saline, buffered saline, dextrose, water, glycerol, ethanol and combinations thereof. The formulation should suit the mode of administration.

The pharmaceutical compositions may be administered in any effective, convenient manner including, for instance, administration by topical, oral, anal, vaginal, intravenous, intraperitoneal, intramuscular, subcutaneous, intranasal or intradermal routes among others.

In therapy or as a prophylactic, the active agent may be administered to an individual as an injectable composition, for example as a sterile aqueous dispersion, preferably isotonic.

Alternatively the composition may be formulated for topical application, for example in the form of ointments, creams, lotions, eye ointments, eye drops, ear drops, mouthwash, impregnated dressings and sutures and aerosols, and may contain appropriate conventional additives, including, for example, preservatives, solvents to assist drug penetration, and emollients in ointments and creams. Such topical formulations may also contain compatible conventional carriers, for example cream or ointment bases, and ethanol or oleyl alcohol for lotions. Such carriers may constitute from about 1% to about 98% by weight of the formulation; more usually they will constitute up to about 80% by weight of the formulation.

In addition to the therapy described above, the compositions of this invention may be used generally as a wound treatment agent to prevent adhesion of bacteria to matrix proteins exposed in wound tissue and for prophylactic use in dental treatment as an alternative to, or in conjunction with, antibiotic prophylaxis.

A vaccine composition is conveniently in injectable form. Conventional adjuvants may be employed to enhance the immune response. A suitable unit dose for vaccination is 0.05-5 µg/kg of antigen, and such dose is preferably administered 1-3 times and with an interval of 1-3 weeks.

With the indicated dose range, no adverse toxicological effects should be observed with the compounds of the invention which would preclude their administration to suitable individuals.

In a further embodiment the present invention relates to diagnostic and pharmaceutical packs and kits comprising one or more containers filled with one or more of the ingredients of the aforementioned compositions of the invention. The ingredient(s) can be present in a useful amount, dosage, formulation or combination. Associated with such container(s) can be a notice in the form prescribed by a governmental agency regulating the manufacture, use or sale of pharmaceuticals or biological products, reflecting approval by the agency of the manufacture, use or sale of the product for human administration.

In connection with the present invention any disease related use as disclosed herein such as, e. g. use of the pharmaceutical composition or vaccine, is particularly a disease or diseased condition which is caused by, linked or associated with *streptococci*, more preferably, *S. pyogenes*. In connection therewith it is to be noted that *S. pyogenes* comprises several strains including those disclosed herein. A disease related, caused or associated with the bacterial infection to be prevented and/or treated according to the present invention includes besides others bacterial pharyngitis, scarlet fever, impetigo, rheumatic fever, necrotizing fasciitis and sepsis in humans.

In a still further embodiment the present invention is related to a screening method using any of the hyperimmune serum reactive antigens or nucleic acids according to the present invention. Screening methods as such are known to the one skilled in the art and can be designed such that an agonist or an antagonist is screened. Preferably an antagonist is screened which in the present case inhibits or prevents the binding of any hyperimmune serum reactive antigen and fragment thereof according to the present invention to an interaction partner. Such interaction partner can be a naturally occurring interaction partner or a non-naturally occurring interaction partner.

The invention also provides a method of screening compounds to identify those which enhance (agonist) or block (antagonist) the function of hyperimmune serum reactive antigens and fragments thereof or nucleic acid molecules of the present invention, such as its interaction with a binding molecule. The method of screening may involve high-throughput.

For example, to screen for agonists or antagonists, the interaction partner of the nucleic acid molecule and nucleic acid, respectively, according to the present invention, maybe a synthetic reaction mix, a cellular compartment, such as a membrane, cell envelope or cell wall, or a preparation of any thereof, may be prepared from a cell that expresses a molecule that binds to the hyperimmune serum reactive antigens and fragments thereof of the present invention. The preparation is incubated with labelled hyperimmune serum reactive antigens and fragments thereof in the absence or the presence of a candidate molecule which may be an agonist or antagonist. The ability of the candidate molecule to bind the binding molecule is reflected in decreased binding of the labelled ligand. Molecules which bind gratuitously, i. e., without inducing the functional effects of the hyperimmune serum reactive antigens and fragments thereof, are most likely to be good antagonists. Molecules that bind well and elicit functional effects that are the same as or closely related to the hyperimmune serum reactive antigens and fragments thereof are good agonists.

The functional effects of potential agonists and antagonists may be measured, for instance, by determining the activity of a reporter system following interaction of the candidate molecule with a cell or appropriate cell preparation, and comparing the effect with that of the hyperimmune serum reactive antigens and fragments thereof of the present invention or molecules that elicit the same effects as the hyperimmune serum reactive antigens and fragments thereof. Reporter systems that may be useful in the regard include but are not limited to colorimetric labelled substrate converted into product, a reporter gene that is responsive to changes in the functional activity of the hyperimmune serum reactive antigens and fragments thereof, and binding assays known in the art.

Another example of an assay for antagonists is a competitive assay that combines the hyperimmune serum reactive antigens and fragments thereof of the present invention and a potential antagonist with membrane-bound binding molecules, recombinant binding molecules, natural substrates or ligands, or substrate or ligand mimetics, under appropriate conditions for a competitive inhibition assay. The hyperimmune serum reactive antigens and fragments thereof can be labelled such as by radioactivity or a colorimetric compound, such that the molecule number of hyperimmune serum reactive antigens and fragments thereof bound to a binding molecule or converted to product can be determined accurately to assess the effectiveness of the potential antagonist.

Potential antagonists include small organic molecules, peptides, polypeptides and antibodies that bind to a hyperimmune serum reactive antigen and fragments thereof of the invention and thereby inhibit or extinguish its activity. Potential antagonists also may be small organic molecules, a peptide, a polypeptide such as a closely related protein or antibody that binds to the same sites on a binding molecule without inducing functional activity of the hyperimmune serum reactive antigens and fragments thereof of the invention.

Potential antagonists include a small molecule which binds to and occupies the binding site of the hyperimmune serum reactive antigens and fragments thereof thereby preventing binding to cellular binding molecules, such that normal biological activity is prevented. Examples of small molecules include but are not limited to small organic molecules, peptides or peptide-like molecules. Other potential antagonists include antisense molecules.

Other potential antagonists include antisense molecules (see {Okano, H. et al., 1991}; OLIGODEOXYNUCLEOTIDES AS ANTISENSE INHIBITORS OF GENE EXPRESSION; CRC Press, Boca Ration, Fla. (1988), for a description of these molecules).

Preferred potential antagonists include derivatives of the hyperimmune serum reactive antigens and fragments thereof of the invention.

As used herein the activity of a hyperimmune serum reactive antigen and fragment thereof according to the present invention is its capability to bind to any of its interaction partner or the extent of such capability to bind to its or any interaction partner.

In a particular aspect, the invention provides the use of the hyperimmune serum reactive antigens and fragments thereof, nucleic acid molecules or inhibitors of the invention to interfere with the initial physical interaction between a pathogen and mammalian host responsible for sequelae of infection. In particular the molecules of the invention may be used: i) in the prevention of adhesion of *S. pyogenes* to mammalian extracellular matrix proteins on in-dwelling devices or to extracellular matrix proteins in wounds; ii) to block protein mediated mammalian cell invasion by, for example, initiating phosphorylation of mammalian tyrosine kinases. {Rosenshine, I. et al., 1992} to block bacterial adhesion between mammalian extracellular matrix proteins and bacterial proteins which mediate tissue damage; iv) to block the normal progression of pathogenesis in infections initiated other than by the implantation of in-dwelling devices or by other surgical techniques.

Each of the DNA coding sequences provided herein may be used in the discovery and development of antibacterial compounds. The encoded protein upon expression can be used as a target for the screening of antibacterial drugs. Additionally, the DNA sequences encoding the amino terminal regions of the encoded protein or Shine-Delgarno or other translation facilitating sequences of the respective mRNA can be used to construct antisense sequences to control the expression of the coding sequence of interest.

The antagonists and agonists may be employed, for instance, to inhibit diseases arising from infection with *Streptococcus*, especially *S. pyogenes*, such as sepsis.

In a still further aspect the present invention is related to an affinity device such affinity device comprises as least a support material and any of the hyperimmune serum reactive antigens and fragments thereof according to the present invention which is attached to the support material. Because of the specificity of the hyperimmune serum reactive antigens and fragments thereof according to the present invention for their target cells or target molecules or their interaction partners, the hyperimmune serum reactive antigens and fragments thereof allow a selective removal of their interaction partner(s) from any kind of sample applied to the support material provided that the conditions for binding are met. The sample may be a biological or medical sample, including but not limited to, fermentation broth, cell debris, cell preparation, tissue preparation, organ preparation, blood, urine, lymph liquid, liquor and the like.

The hyperimmune serum reactive antigens and fragments thereof may be attached to the matrix in a covalent or non-covalent manner. Suitable support material is known to the one skilled in the art and can be selected from the group comprising cellulose, silicon, glass, aluminum, paramagnetic beads, starch and dextrane.

The present invention is further illustrated by the following figures, examples and the sequence listing from which further features, embodiments and advantages may be taken. It is to be understood that the present examples are given by way of illustration only and not by way of limitation of the disclosure.

In connection with the present invention

Figure 7:
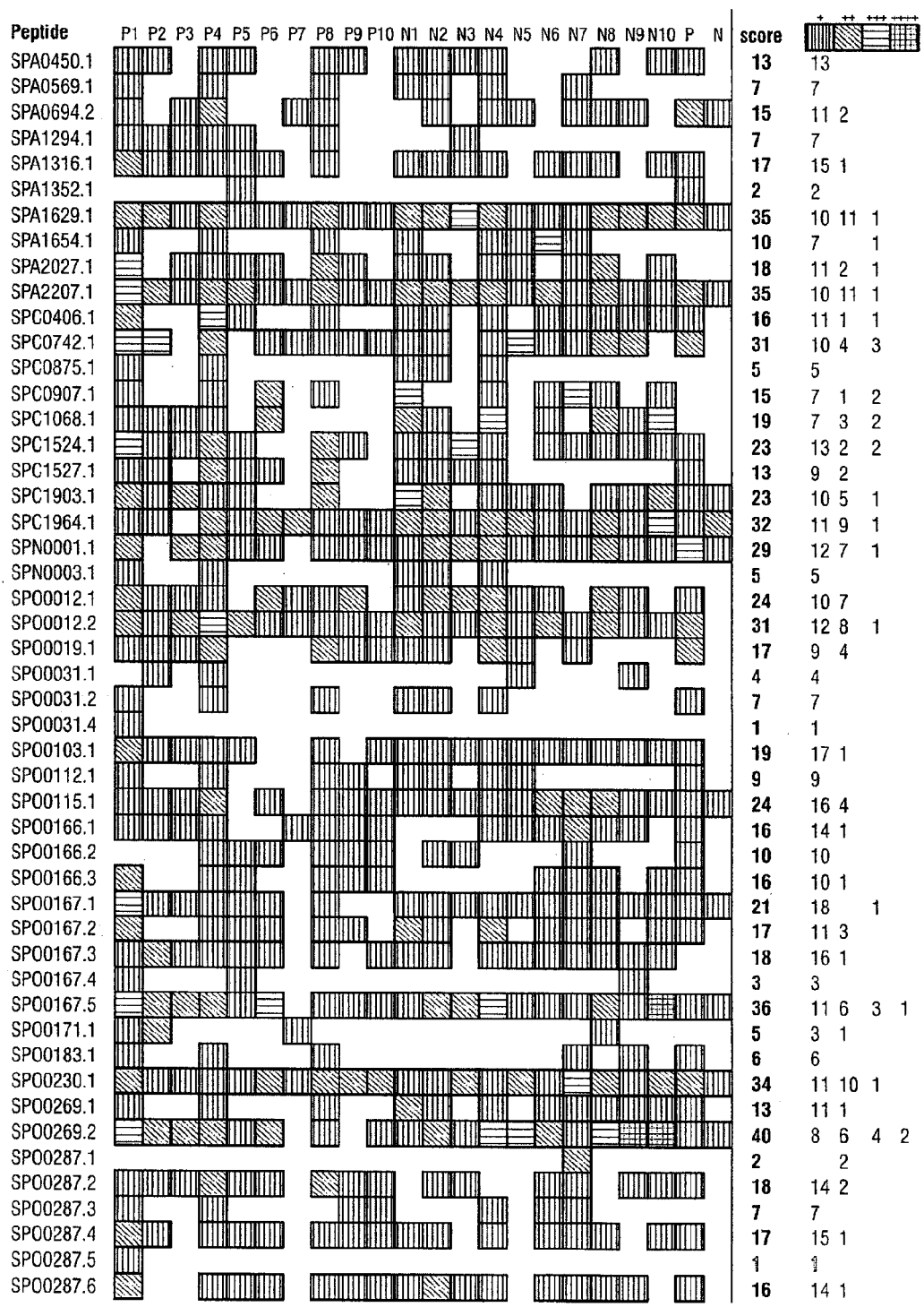
Figure 7:
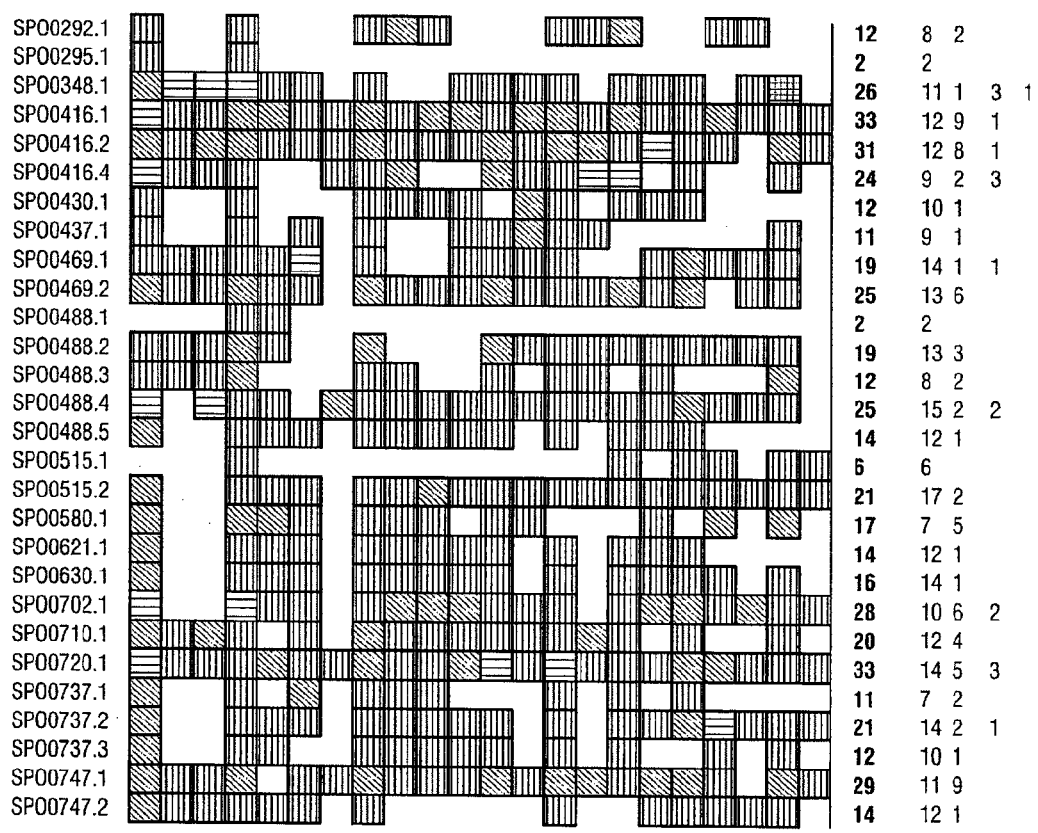
Figure 7:
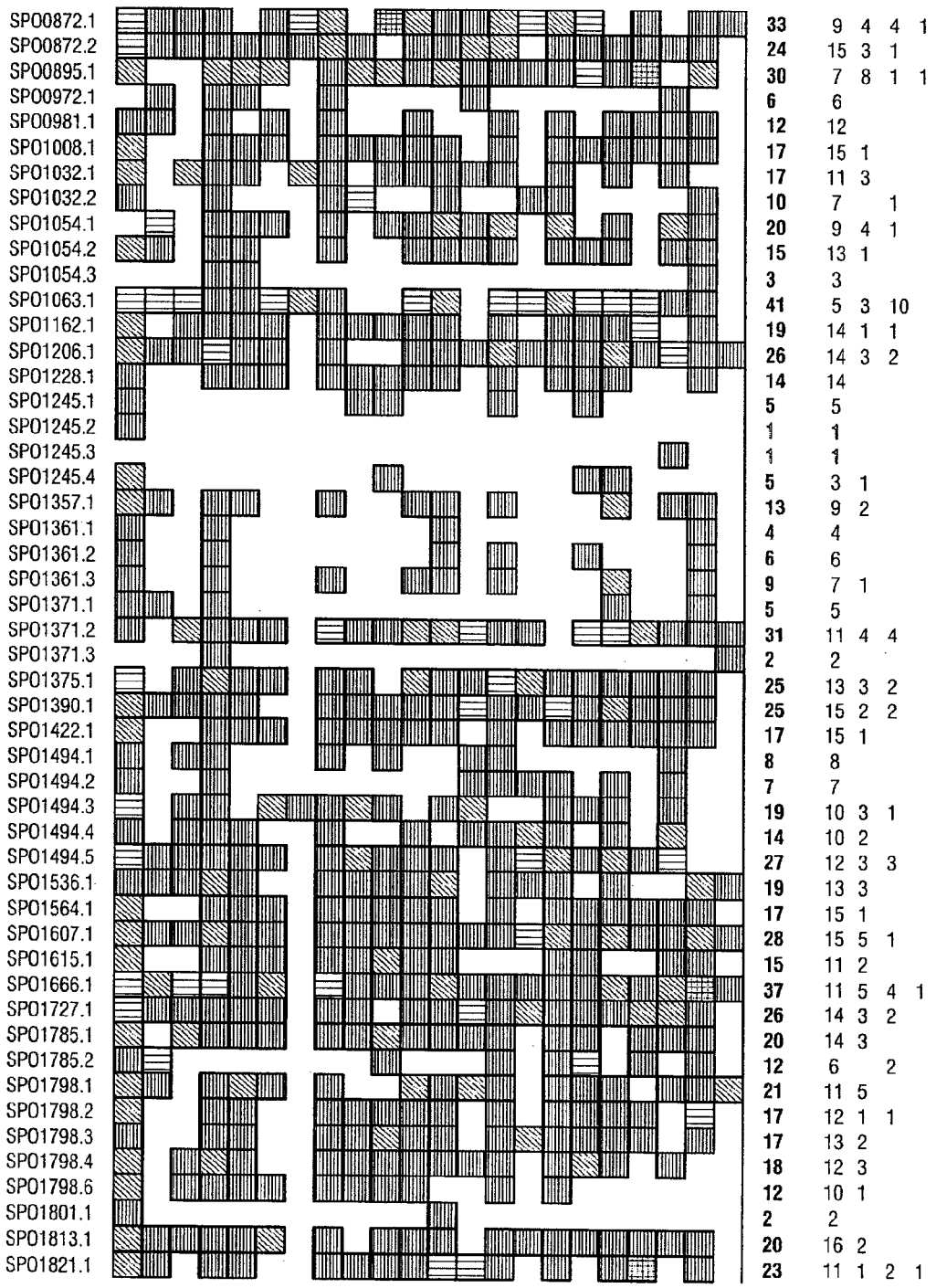
Figure 7:
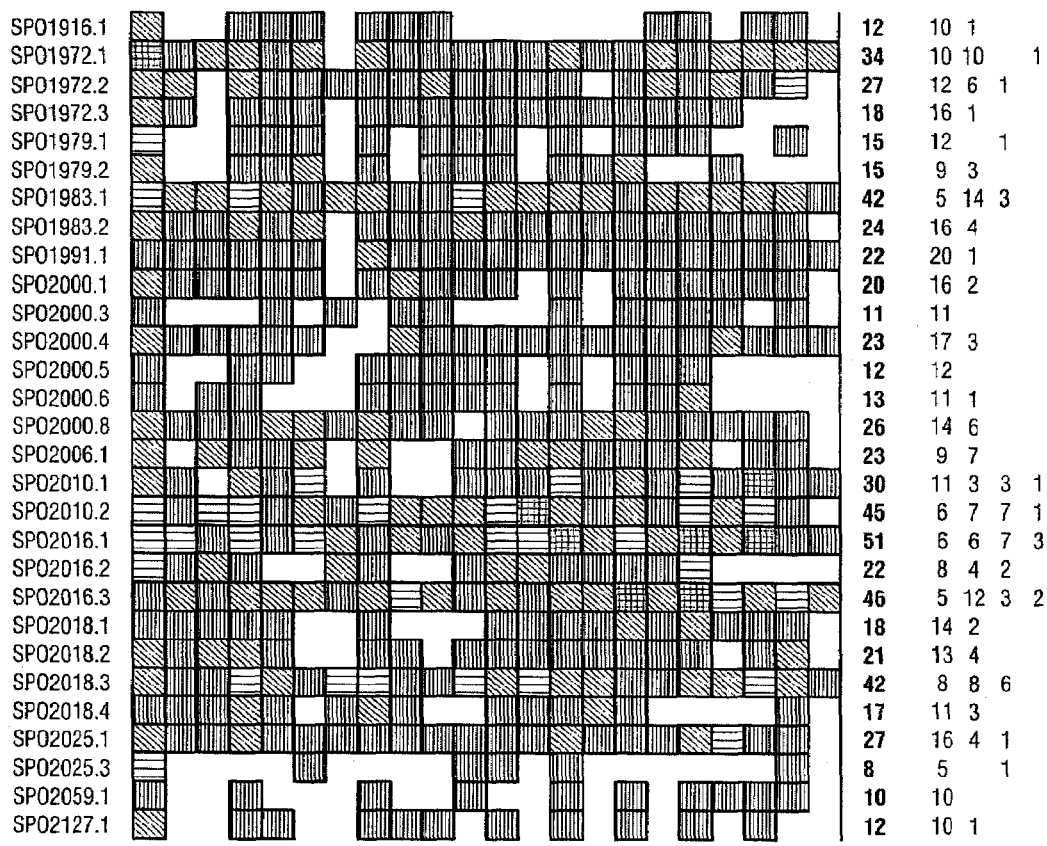

FIG. 7, in conjunction with Table 2, shows the epitope serology with human sera.

Table 1 shows the summary of all screens performed with genomic S. pyogenes libraries and human serum.

Table 2, in conjunction with FIG. 7, shows the epitope serology with human sera.

Table 3 shows the summary of the gene distribution analysis for the identified antigens in fifty S. pyogenes strains.

Table 4 summarizes the information on the antigenic proteins used for the immunization experiments.

Table 5 shows the variability of antigenic proteins in six different strains of S. pyogenes.

The figures to which it might be referred to in the specification are described in the following in more details.

Figure 1:
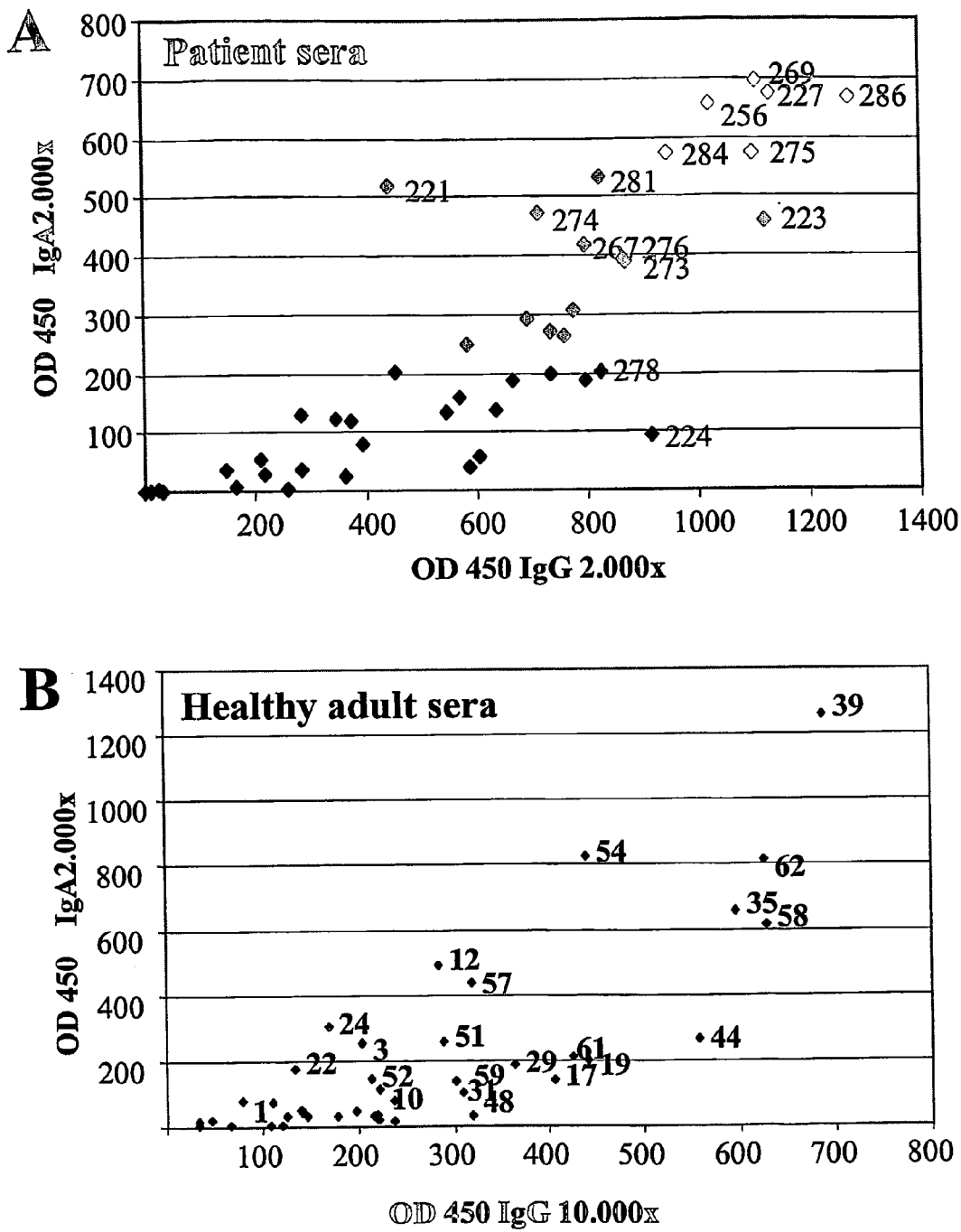
FIG. 1 shows the characterization of S. pyogenes specific human sera.

FIG. 1 shows the characterization of human sera for S. pyogenes as measured by ELISA.

Figure 2:
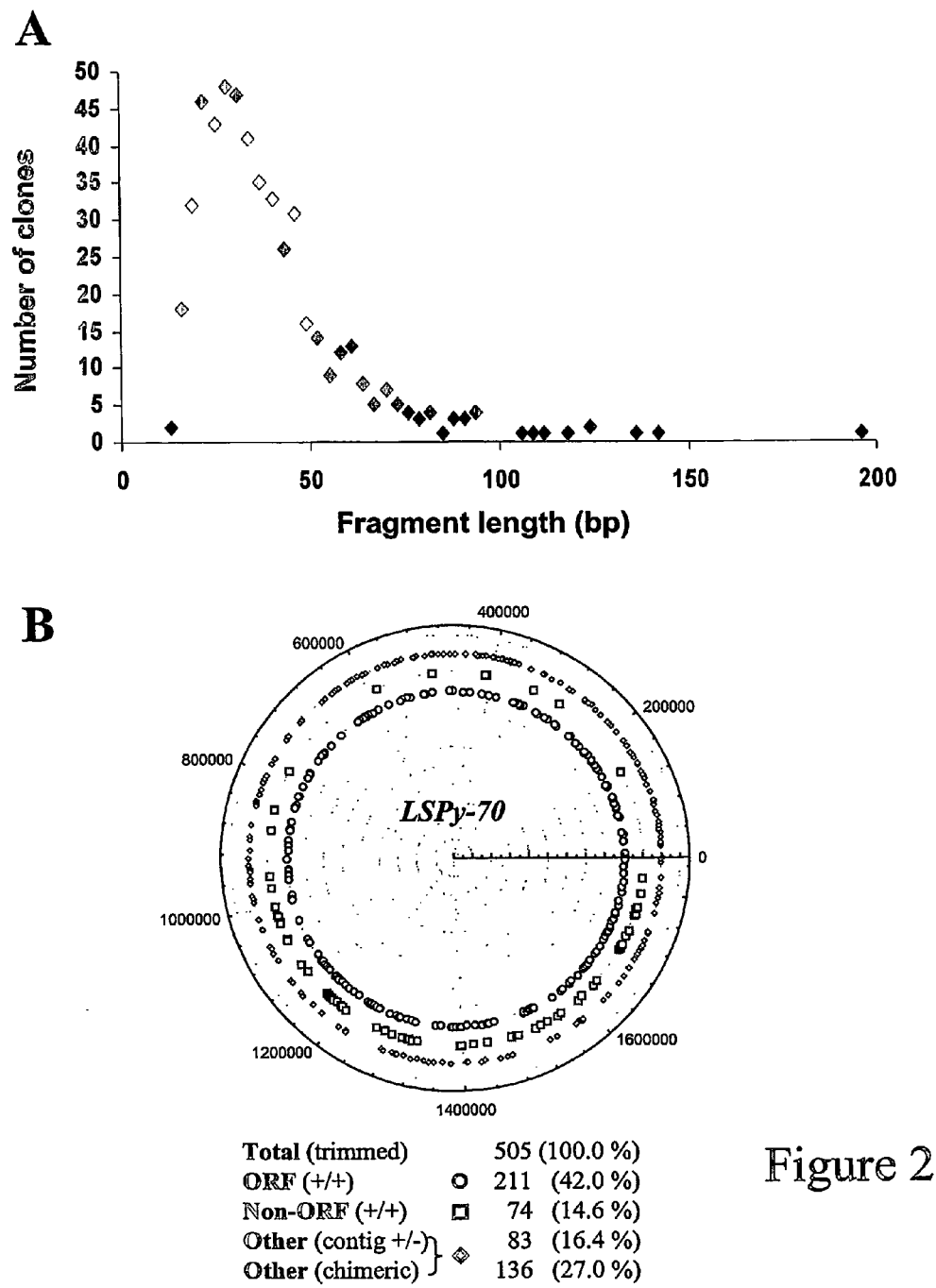
FIG. 2 shows the characterization of the small fragment genomic library, LSPy-70, from Streptococcus pyogenes SF370/M1.

FIG. 2 shows the fragment size distribution of the Streptococcus pyogenes SF370/M1 small fragment genomic library, LSPy-70. After sequencing 576 randomly selected clones sequences were trimmed to eliminate vector residues and the number of clones with various genomic fragment sizes were plotted. (B) Graphic illustration of the distribution of the same set of randomly sequenced clones of LSPy-70 over the S. pyogenes chromosome. Blue circles indicate matching sequences to annotated ORFs in +/+ orientation. Red rectangles represent fully matched clones to non-coding chromosomal sequences in +/+ orientation. Green diamonds positions all clones with complementary or chimeric sequences. Numeric distances in base pairs are indicated over each circular genome for orientation. Partitioning of various done sets within the library is given in numbers and percentage at the bottom of the figure.

Figure 3:
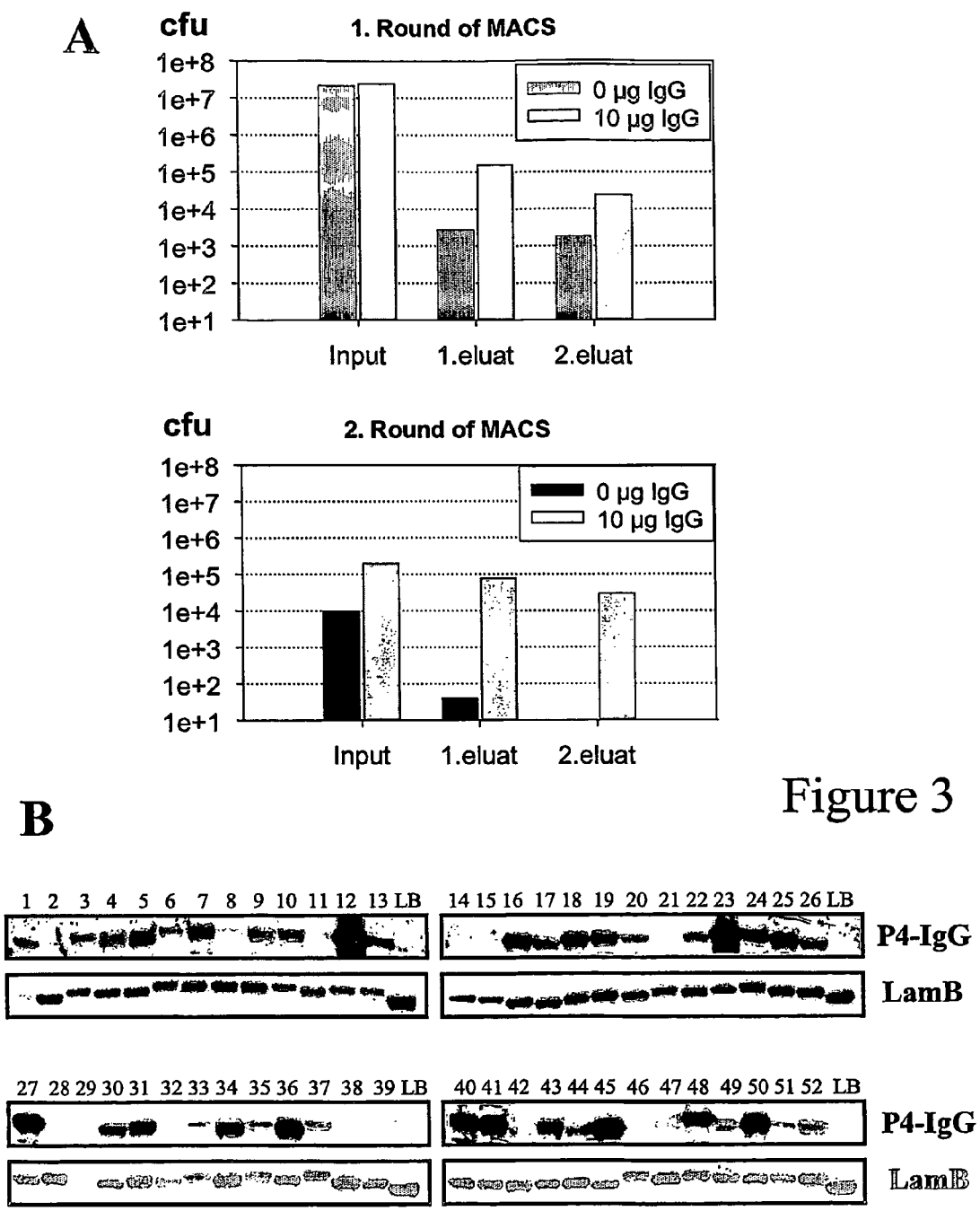
FIG. 3 shows the selection of bacterial cells by MACS using biotinylated human IgGs.

FIG. 3A shows the MACS selection with biotinylated human IgGs. The LSPy-70 library in pMAL9.1 was screened with 10 μg biotinylated, human serum (P4-IgG) in the first and with 1 μg in the second selection round. As negative control, no serum was added to the library cells for screening. Number of cells selected after the $1^{st}$ and $2^{nd}$ elution are shown for each selection round. FIG. 3B shows the reactivity of specific clones (1-52) isolated by bacterial surface display as analysed by Western blot analysis with the human serum (P4-IgG) used for selection by MACS at a dilution of 1:3,000. As a loading control the same blot was also analysed with antibodies directed against the platform protein LamB at a dilution of 1:5,000. LB, Extract from a clone expressing LamB without foreign peptide insert.

Figure 4:
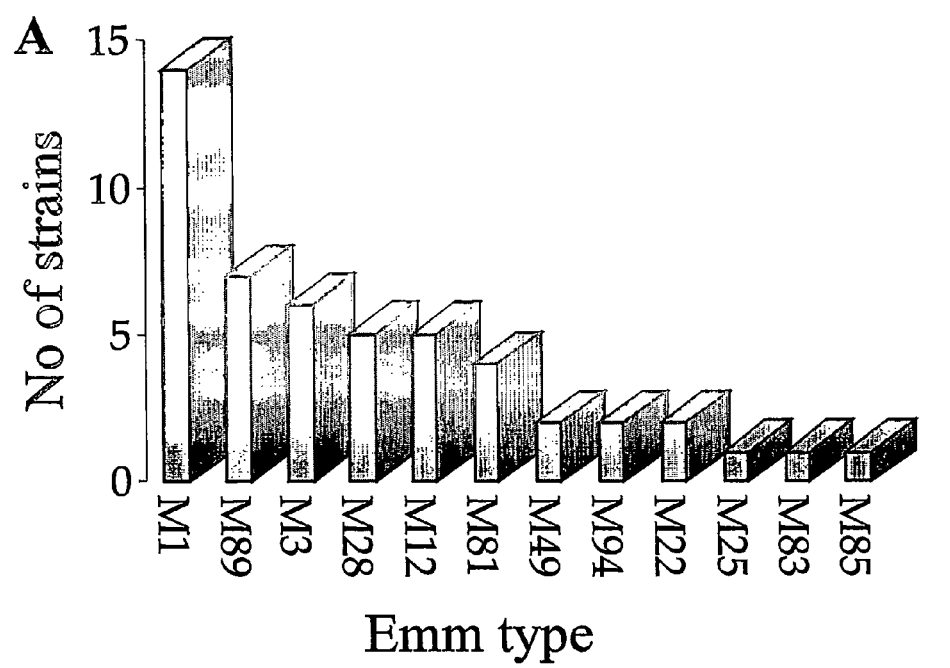
FIG. 4 shows an example for the gene distribution study with the identified antigens.
Figure 4:
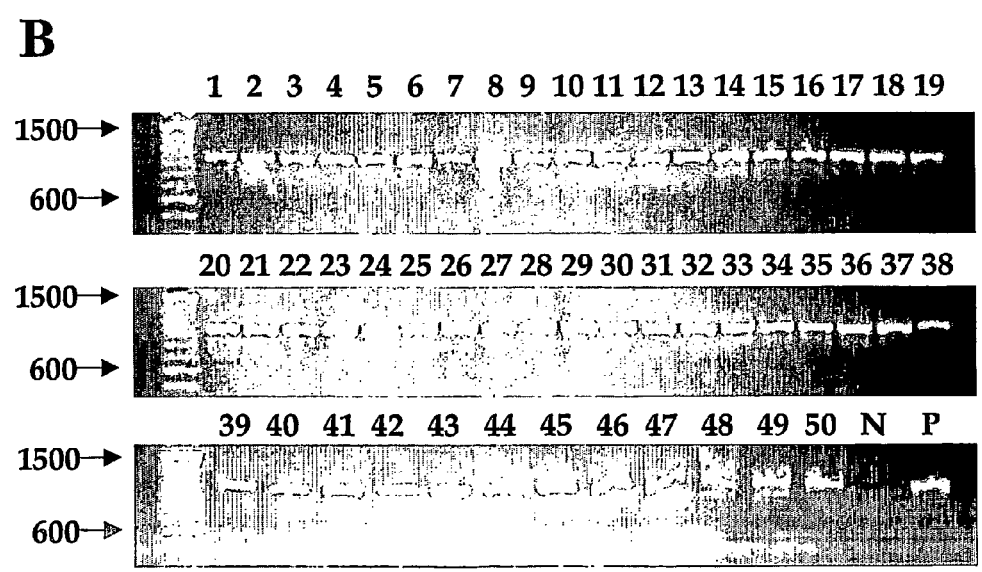

FIG. 4A shows the emm types of S. pyogenes analysed for the gene distribution study. FIG. 4B shows the PCR analysis for the gene distribution of genes Spy0269 with the respective oligonucleotides. The predicted size of the PCR fragments is 1,000 bp. 1-50, S. pyogenes strains as listed under A; N, no genomic DNA added; P, genomic DNA from S. pyogenes SF310, which served as template for library construction.

Figure 5:
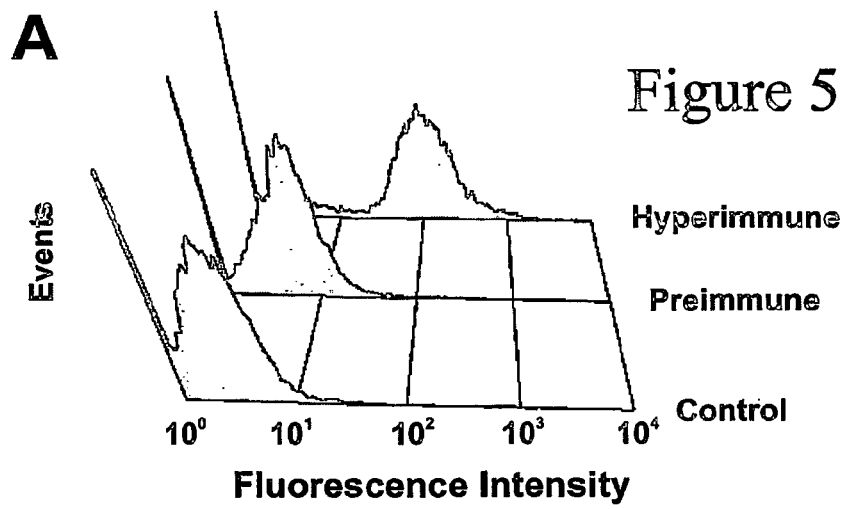
FIG. 5 shows cell surface staining by flow cytometry.
Figure 5:
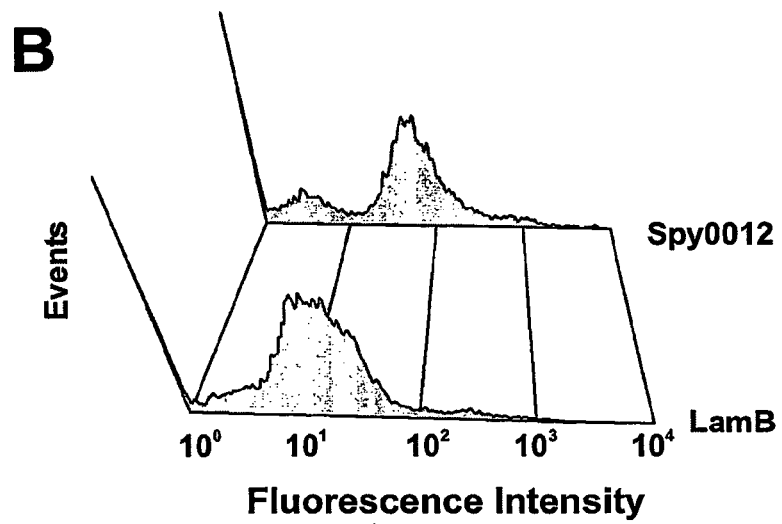
Figure 5:
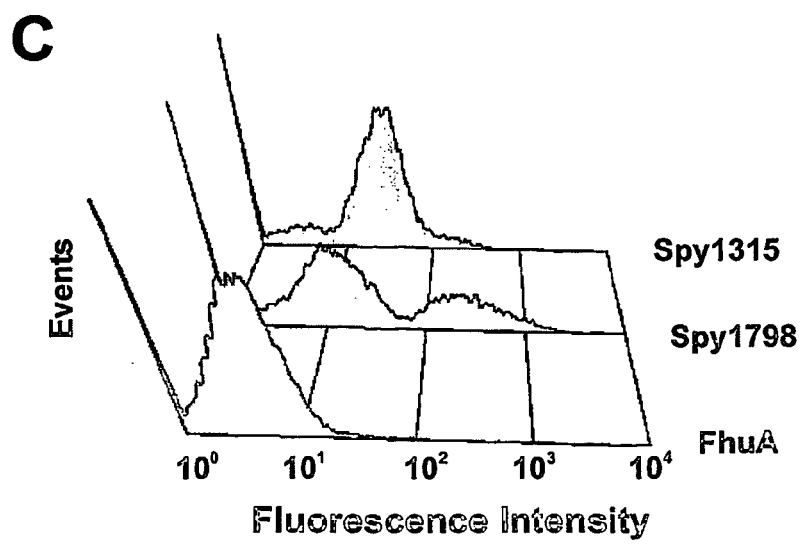

FIG. 5 Detection of specific antibody binding on the cell surface of Group A Streptococcus by flow cytometry. In FIG. 5A preimmune mouse sera and polyclonal sera raised against S. pyogenes lysate were incubated with S. pyogenes strain SF370/M1 and analysed by flow cytometry. Control represents the level of non-specific binding of the secondary antibody to the surface of S. pyogenes cells. The histograms in FIG. 5B and 5C indicate the increased fluorescence due to specific binding of anti-Spy0012 (B) or anti-Spy1315 and anti-Spy1798 (C) antibodies in comparison to the control sera against the two platform proteins LamB and FhuA, respectively.

Figure 6:
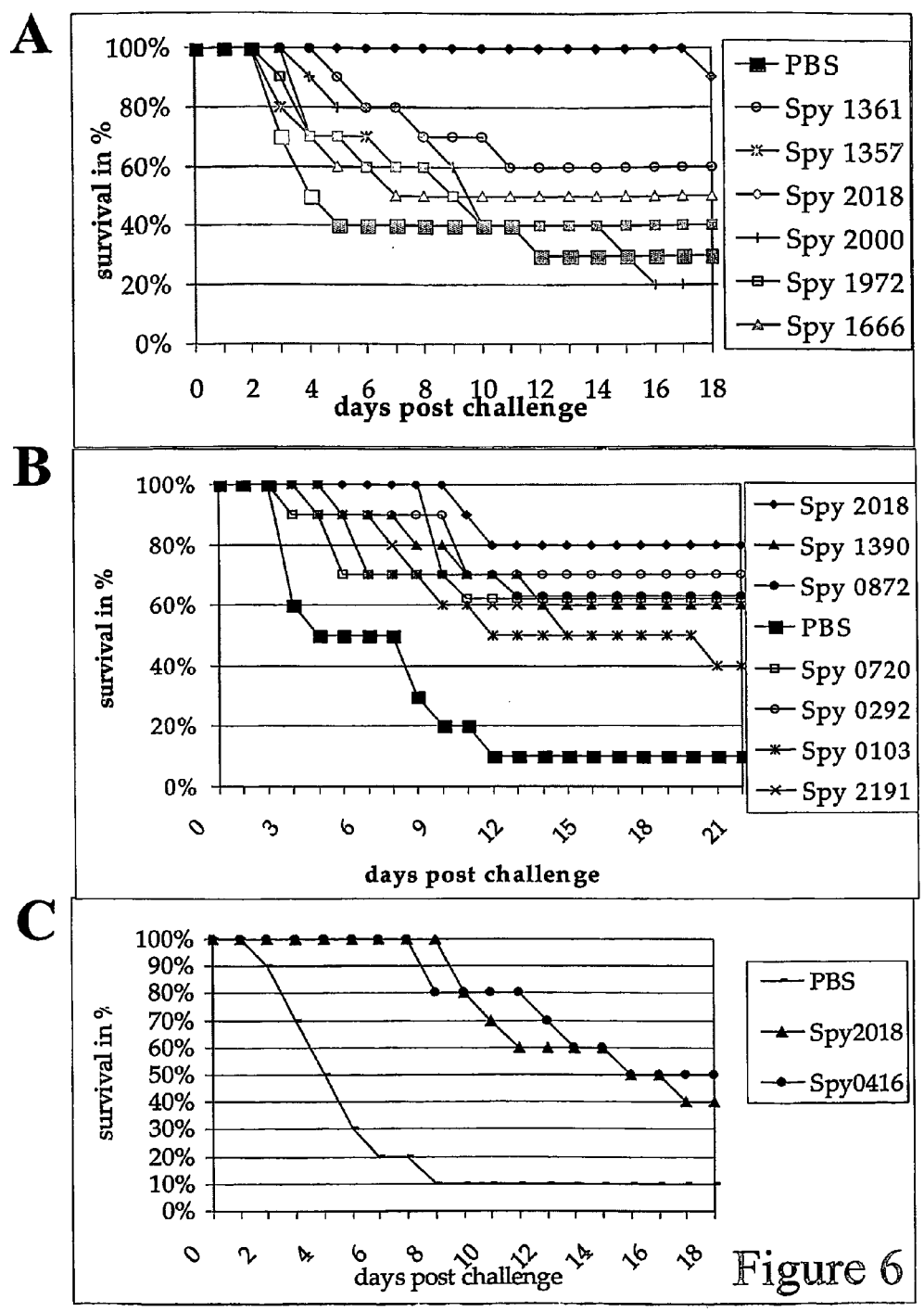
FIG. 6 shows the protective value of identified recombinant S. pyogenes antigens.

FIG. 6 NMRI mice were immunized with 3 consecutive doses of recombinant protein (50pg/dose) two weeks apart on days 0, 14 and 28. As negative control, mice were immunized with PBS in the presence of adjuvant. The M1 protein (Spy2018) served as positive control for the challenge experiment. The bacterial challenge was performed with $5 \times 10^7$ S. pyogenes AP1 cells i.v. and survival of mice was observed daily for A) 18 days, B) 21 days and C) 19 days, respectively.

FIG. 7 Immune reactivity of individual synthetic peptides representing selected epitopes with individual human sera is shown. Extent of reactivity is pattern coded; white: −(<50 U); vertical lines: +(50-119 U); diagonal lines: ++(120-199 U); horizontal lines: +++(200-1000 U); and crossed lines: ++++ (>1000 U). ELISA units (U) are calculated from $OD_{545\ nm}$ readings and the serum dilution after correction for background. Score, sum of all reactivities (addition of the number of all +); P1 to P10 sera are from patients with acute pharyngitis, and N1 to N10 sera are from healthy adults. P and N are used as internal controls. Peptide names: SPO0012, annotated ORF Spy0012; SPA0450, potential novel ORF in alternative reading-frame of Spy0450; SPC0406, potential novel ORF on complement of Spy0406; SPN0001, potential novel ORF in non-coding region.

Table 1: Immunogenic Proteins Identified by Bacterial Surface Display.

A, LSPy-70 library in lamB with IC3-IgG (1588), B, LSPy-70 library in lamB with IC3-IgA (1539), C, LSPy-70 library in lamB with IC6IgG (1173), D, LSPy-70 library in lamB with P4-IgG (1138), E, LSPy-70 library in lamB with P4IgA (981), F, LSPy-150 library in btuB with IC3-IgG (991), G, LSPy-150 library in btuB with IC6-IgG. (1036), H, LSPy-150 library in btuB with P4IgG (681), I, LSPy400 library in fhuA with IC3-IgG (559), K, LSPy-400 library in fhuA with IC6-IgG (543), L, LSPy-400 library in fhuA with P4-IgG (20), *, prediction of antigenic sequences longer than 5 amino acids was performed with the program ANTIGENIC {Kolaskar, A. et al., 1990}.

Table 2: Epitope Serology with Human Sera

Description of individual synthetic peptides representing selected epitopes for which immune reactivity with individual human sera is shown in FIG. 7. Peptide names: SP00012, annotated ORF Spy0012; SPA0450, potential novel ORF in alternative reading-frame of Spy0450; SPC0406, potential novel ORF on complement of Spy0406; SPN0001, potential novel ORF in non-coding region.

Table 3: Gene Distribution in S. pyogenes Strains.

Fifty S. pyogenes strains as shown in FIG. 4A were tested by PCR with oligonucleotides specific for the genes encoding relevant antigens. The PCR fragment of one selected PCR fragment was sequenced in order to confirm the amplification of the correct DNA fragment. *, number of amino acid substitutions in strain M89 as compared to S. pyogenes SF370 (M1). #, alternative strain used for sequencing, because gene was not present in M89.

Table 4: Recombinant Proteins used for Immunisation Experiments in NMRI Mice.

Immunization with recombinant antigens and challenge with pathogenic S. pyogenes AP1 was performed as described under Experimental procedures. A, The amino acids of the respective antigen contained within the recombinant protein as used for the immunization experiments in animals are given in relation to the full-length protein. B, Percentage of survival is represented as protection and parentheses describes the percentage of protection of the negative control (PBS immunized) followed by the percentage of protection of the positive control (Spy2018). C, Spy0269 was selected due to the fact that the mice showed better survival although at the end of the observation time all mice died. This is reflected by the average survival time as measured in days: 14.6 (Spy0269), 11.6 (PBS) and 19.3 days (Spy2018).

Table 5: Sequence Variation of Antigenic Proteins from S. pyogenes.

Antigenic proteins were analysed for amino acid exchanges in six different S. pyogenes strains as listed under experimental procedures. The residue number indicates the position of the amino acid in the full-length protein. In case of Spy1666, changes relative to a homologous gene in Streptococcus pneumoniae TIGR4 (SP0334) are listed, because the gene is highly conserved in S. pyogenes as well as S. pneumoniae . A, amino acid residue in protein from S. pyogenes SF370. B, amino acid residue(s), which may occur in any one the analysed genes from the other five S. pyogene strains, if different from S. pyogenes SF370. C, residues of Spy0416 involved in catalytic activity. Changes in these residues are anticipated to render the enzyme inactive and are therefore exchanged experimentally with alanine, serine, threonine of glycine to produce an enzymatically inactive recombinant protein.

EXAMPLES

Example 1

Preparation of Antibodies from Human Serum

The antibodies produced against group A *streptococci* by the human immune system and present in human sera are indicative of the in vivo expression of the antigenic proteins and their immunogenicity. These molecules are essential for the identification of individual antigens in the approach as described in the present invention, which is based on the interaction of the specific anti-*streptococcal* antibodies and the corresponding S. pyogenes peptides or proteins. To gain access to relevant antibody repertoires, human sera were collected from I. patients with acute S. pyogenes infections, such as pharyngitis, wound infection and bacteraemia. (S. pyogenes was shown to be the causative agent by medical microbiological tests), II. uninfected healthy adults, since group A *streptococcal* infections are common, and antibodies are present as a consequence of natural immunization from previous encounters with *streptococci*.

The sera were characterized for anti-S. pyogenes antibodies by a series of ELISA and immunoblotting assays. Several *streptococcal* antigens have been used to show that the titers measured were not a result of the sum of cross-reactive antibodies. For that purpose two different antigen preparation were used: whole cell extract or culture supernatant proteins prepared from S. pyogenes SF370/M1 cultured overnight (stationary phase) in THB (Todd-Hewitt Broth) growth medium. Both IgG and IgA antibody levels were determined. Sera were selected for further analysis by immunoblotting based on total antibody titers against the two antigen preparations.

The titers were compared at given dilutions where the response was linear (FIG. 1). Sera were ranked based on the reactivity against multiple *streptococcal* components, and the highest ones were selected for further analysis by immunoblotting. This extensive antibody characterization approach has led to the unambiguous identification of anti-*streptococcal* hyperimmune sera.

Recently it was reported that not only IgG, but also IgA serum antibodies can be recognized by the FcRIII receptors of PMNs and promote opsonization {Phillips-Quagliata, J. et al., 2000; Shibuya, A. et al., 2000}. The primary role of IgA antibodies is neutralization, mainly at the mucosal surface. The level of serum IgA reflects the quality, quantity and specificity of the dimeric secretory IgA. For that reason the serum collection was not only analyzed for anti-*streptococcal* IgG, but also for IgA levels. In the ELISA assays highly specific secondary reagents were used to detect antibodies from the high affinity types, such as IgG and IgA, but avoided IgM. Production of IgM antibodies occurs during the primary adaptive humoral response, and results in low affinity antibodies, while IgG and IgA antibodies had already undergone affinity maturation, and are more valuable in fighting or preventing disease Experimental Procedures Peptide Synthesis Peptides were synthesized in small scale (4 mg resin; up to 288 in parallel) using standard F-moc chemistry on a Rink amide resin (PepChem, Tuibingen, Germany) using a SyroII synthesizer (Multisyntech, Witten, Germany). After the sequence was assembled, peptides were elongated with Fmoc-epsilon-aminohexanoic acid (as a linker) and biotin (Sigma, St. Louis, Mo.; activated like a normal amino acid). Peptides were cleaved off the resin with 93% TFA, 5% triethylsilane, and 2% water for one hour. Peptides were dried under vacuum and freeze dried three times from acetonitrile/water (1:1). The presence of the correct mass was verified by mass spectrometry on a Reflex m MALDI-TOF (Bruker, Bremen Germany). The peptides were used without further purification.

Enzyme Linked Immune Assay (ELISA).

For serum characterization: ELISA plates (Maxisorb, Millipore) were coated with 5-10 µg/ml total protein diluted in coating buffer (0.1M sodium carbonate pH 9.2). Three dilutions of sera (2,000×, 10,000×, 50,000×) were made in PBS-BSA.

For peptide serology: Biotin-labeled peptides were coating on Streptavidin ELISA plates (EXICON) at 10 μg/ml concentration according to the manufacturer's instructions. Sera were tested at two dilutions, 200× and 1,000×.

Highly specific Horse Radish Peroxidase (HRP)-conjugated anti-human IgG or anti-human IgA secondary antibodies (Southern Biotech) were used according to the manufacturers' recommendations (dilution: 1,000×). Antigen-antibody complexes were quantified by measuring the conversion of the substrate (ABTS) to colored product based on $OD_{405\ nm}$ readings in an automated ELISA reader (TECAN SUNRISE). Following manual coating, peptide plates were processed and analyzed by the Gemini 160 ELISA robot (TECAN) with a built-in reader (GENIOS, TECAN).

Immunoblotting

Total bacterial lysate and culture supernatant samples were prepared from in vitro grown S. pyogenes SF370/M1. 10 to 25 μg total protein/lane was separated by SDS-PAGE using the BioRad Mini-Protean 3 Cell electrophoresis system and proteins transferred to nitrocellulose membrane (ECL, Amersham Pharmacia). After overnight blocking in 5% milk, antisera at 2,000× dilution were added, and HRPO labeled anti-mouse IgG was used for detection.

Preparation: of Bacterial Antigen Extracts

Total bacterial lysate: Bacteria were lysed by repeated freeze-thaw cycles: incubation on dry ice/ethanol-mixture until frozen (1 min), then thawed at 37° C. (5 min): repeated 3 times. This was followed by sonication and collection of supernatant by centrifugation (3,500 rpm, 15 min, 4° C.).

Culture supernatant: After removal of bacteria, the supernatant of overnight grown bacterial cultures was precipitated with ice-cold ethanol (100%): 1 part supernatant/3 parts ethanol incubated o/n at −20° C. Precipitates were collected by centrifugation (2,600 g, for 15 min) and dried. Dry pellets were dissolved either in PBS for ELISA, or in urea and SDS-sample buffer for SDS-PAGE and immunoblotting. The protein concentration of samples was determined by Bradford assay.

Purification of antibodies for genomic screening. Five sera from both the patient and the non-infected group were selected based on the overall anti-streptococcal titers for a serum pool used in the screening procedure. Antibodies against E. coli proteins were removed by incubating the heat-inactivated sera with whole cell E. coli cells (DH5alpha, transformed with pHIE11, grown under the same condition as used for bacterial surface display). Highly enriched preparations of IgGs from the pooled, depleted sera were generated by protein G affinity chromatography, according to the manufacturer's instructions (UltraLink Immobilized Protein G, Pierce). IgA antibodies were purified also by affinity chromatography using biotin-labeled anti-human IgA (Southern Biotech) immobilized on Streptavidin-agarose (GIBCO BRL). The efficiency of depletion and purification was checked by SDS-PAGE, Western blotting, ELISA and protein concentration measurements.

Example 2

Generation of Highly Random, Frame-selected, Small-fragment, Genomic DNA Libraries of *Streptococcus pyogenes*

Experimental Procedures

Preparation of *streptococcal* genomic DNA. 50 ml Todd-Hewitt Broth medium was inoculated with S. pyogenes SF370/M1 bacteria from a frozen stab and grown with aeration and shaking for 18 h at 37° C. The culture was then harvested, centrifuged with 1,600×g for 15 min and the supernatant was removed. Bacterial pellets were washed 3× with PBS and carefully re-suspended in 0.5 ml of Lysozyme solution (100 mg/ml). 0.1 ml of 10 mg/ml heat treated RNase A and 20 U of RNase Ti were added, mixed carefully and the solution was incubated for 1 h at 37° C. Following the addition of 0.2 ml of 20% SDS solution and 0.1 ml of Proteinase K (10 mg/ml) the tube was incubated overnight at 55° C. ⅓ volume of saturated NaCl was then added and the solution was incubated for 20 min at 4° C. The extract was pelleted in a microfuge (13,000 rpm) and the supernatant transferred into a new tube. The solution was extracted with $PhOH/CHCl_3/IAA$ (25:24:1) and with $CHCl_3/IAA$ (24:1). DNA was precipitated at room temperature by adding 0.6× volume of Isopropanol, spooled from the solution with a sterile Pasteur pipette and transferred into tubes containing 80% ice-cold ethanol. DNA was recovered by centrifuging the precipitates with 10-12,000×g, then dried on air and dissolved in $ddH_2O$.

Preparation of small genomic DNA fragments. Genomic DNA fragments were mechanically sheared into fragments ranging in size between 150 and 300 bp using a cup-horn sonicator. (Bandelin Sonoplus UV. 2200 sonicator equipped with a BB5 cup horn, 10 sec. pulses at 100% power output) or into fragments of size between 50 and 70 bp by mild DNase I treatment (Novagen). It was observed that sonication yielded a much tighter fragment size distribution when breaking the DNA into fragments of the 150-300 bp size range. However, despite extensive exposure of the DNA to ultrasonic wave-induced hydromechanical shearing force, subsequent decrease in fragment size could not be efficiently and reproducibly achieved. Therefore, fragments of 50 to 70 bp in size were obtained by mild DNase I treatment using Novagen's shotgun cleavage kit. A 1:20 dilution of DNase I provided with the kit was prepared and the digestion was performed in the presence of $MnCl_2$ in a 60 μl volume at 20° C. for 5 min to ensure double-stranded cleavage by the enzyme. Reactions were stopped with 2 μl of 0.5 M EDTA and the fragmentation efficiency was evaluated on a 2% TAE-agarose gel. This treatment resulted in total fragmentation of genomic DNA into near 50-70 bp fragments. Fragments were then blunt-ended twice using T4 DNA Polymerase in the presence of 100 μM each of dNTPs to ensure efficient flushing of the ends. Fragments were used immediately in ligation reactions or frozen at −20° C. for subsequent use.

Description of the vectors. The vector pMAL4.31 was constructed on a pASK-IBA backbone {Skerra, A., 1994} with the beta-lactamase (bla) gene exchanged with the Kanamycin resistance gene. In addition bla gene was cloned into the multiple cloning site. The sequence encoding mature beta-lactamase is preceded by the leader peptide sequence of ompA to allow efficient secretion across the cytoplasmic membrane. Furthermore a sequence encoding the first 12 amino acids (spacer sequence) of mature beta-lactamase follows the ompA leader peptide sequence to avoid fusion of sequences immediately after the leader peptidase cleavage site, since e.g. clusters of positive charged amino acids in this region would decrease or abolish translocation across the cytoplasmic membrane {Kajava, A. et al., 2000}. A SmaI restriction site serves for library insertion. An upstream FseI site and a downstream NotI site, which were used for recovery of the selected fragment, flank the SmaI site. The three restriction sites are inserted after the sequence encoding the 12 amino acid spacer sequence in such a way that the bla gene is transcribed in the −1 reading frame resulting in a stop codon 15 bp after the NotI site. A +1 bp insertion restores the bla ORF so that beta-lactamase protein is produced with a consequent gain of Ampicillin resistance.

The vector pMAL9.1 was constructed by cloning the lamB gene into the multiple cloning site of pEH1 {Hashemzadeh-Bonehi, L. et al., 1998}. Subsequently, a sequence was inserted in lamB after amino acid 154, containing the restriction sites FseI, SmaI and NotI. The reading frame for this insertion was constructed in such a way that transfer of frame-selected DNA fragments excised by digestion with FseI and NotI from plasmid pMAL4.31 yields a continuous reading frame of lamB and the respective insert.

The vector pMAL10.1 was constructed by cloning the btuB gene into the multiple cloning site of pEH1. Subsequently, a sequence was inserted in btuB after amino acid 236, containing the restriction sites FseI, XbaI and NotI. The reading frame for this insertion was chosen in a way that transfer of frame-selected DNA fragments excised by digestion with FseI and NotI from plasmid pMAL4.31 yields a continuous reading frame of btuB and the respective insert.

The vector pHIE11 was constructed by cloning the fhuA gene into the multiple cloning site of pEH1. Thereafter, a sequence was inserted fhuA after amino acid 405, containing the restriction site FseI, XbaI and NotI. The reading frame for this insertion was chosen in a way that transfer of frame-selected DNA fragments excised by digestion with FseI and NotI from plasmid pMAL4.31 yields a continuous reading frame of fhuA and the respective insert.

Cloning and evaluation of the library for frame selection. Genomic S. pyogenes DNA fragments were ligated into the SmaI site of the vector pMAL4.31. Recombinant DNA was electroporated into DH10B electrocompetent E. coli cells (GIBCO BRL) and transformants plated on LB-agar supplemented with Kanamycin (50 µg/ml) and Ampicillin (50 µg/ml). Plates were incubated over night at 37° C. and colonies collected for large scale DNA extraction. A representative plate was stored and saved for collecting colonies for colony PCR analysis and large-scale sequencing. A simple colony PCR assay was used to initially determine the rough fragment size distribution as well as insertion efficiency. From sequencing data the precise fragment size was evaluated, junction intactness at the insertion site as well as the frame selection accuracy (3n+1 rule).

Cloning and evaluation of the library for bacterial surface display. Genomic DNA fragments were excised from the pMAL4.31 vector, containing the S. pyogenes library with the restriction enzymes FseI and NotI. The entire population of fragments was then transferred into plasmids pMAL9.1 (LamB), p14AL10.1 (BtuB) or pHIE11 (FhuA), which have been digested with FseI and NotI. Using these two restriction enzymes, which recognise an 8 bp GC rich sequence, the reading frame that was selected in the pMAL4.31 vector is maintained in each of the platform vectors. The plasmid library was then transformed into E. coli DH5alpha cells by electroporation. Cells were plated onto large LB-agar plates supplemented with 50 µg/ml Kanamycin and grown over night at 37° C. at a density yielding clearly visible single colonies. Cells were then scraped off the surface of these plates, washed with fresh LB medium and stored in aliquots for library screening at −80° C.

Results

Libraries for frame selection. Three libraries (LSPy70, LSPy150 and LSPy300) were generated in the pMAL4.31 vector with sizes of approximately 70, 150 and 300 bp, respectively. For each library, ligation and subsequent transformation of approximately 1 µg of pMAL4.31 plasmid DNA and 50 µg of fragmented genomic S. pyogenes DNA yielded $4 \times 10^5$ to $2 \times 10^6$ clones after frame selection. To assess the randomness of the libraries, approximately 600 randomly chosen clones of LSPy70 were sequenced. The bioinformatic analysis showed that of these clones only very few were present more than once. Furthermore, it was shown that 90% of the clones fell in the size range between 16 and 61 bp with an average size of 34 bp (FIG. 2). All sequences followed the 3n+1 rule, showing that all clones were properly frame selected.

Bacterial surface display libraries. The display of peptides on the surface of E. coli required the transfer of the inserts from the LSPy libraries from the frame selection vector pMAL4.31 to the display plasmids pMAL9.1 (LamB), pMAL10.1 (BtuB) or pHIE11 (FhuA). Genomic DNA fragments were excised by FseI and NotI restriction and ligation of 5 ng inserts with 0.1 µg plasmid DNA and subsequent transformation into DH5alpha cells resulted in $2$-$5 \times 10^6$ clones. The clones were scraped off the LB plates and frozen without further amplification.

Example 3

Identification of Highly Immunogenic Peptide Sequences from S. pyogenes using Bacterial Surface Displayed Genomic Libraries and Human Serum Experimental Procedures MACS screening. Approximately $2.5 \times 10^8$ cells from a given library were grown in 5 ml LB-medium supplemented with 50 µg/ml Kanamycin for 2 h at 37° C. Expression was induced by the addition of 1 mM IPTG for 30 min. Cells were washed twice with fresh LB medium and approximately $2 \times 10^7$ cells re-suspended in 100 µl LB medium and transferred to an Eppendorf tube.

10 µg of biotinylated, human IgGs from purified from serum was added to the cells and the suspension incubated over night at 4° C. with gentle shaking. 900 µl of LB medium was added, the suspension mixed and subsequently centrifuged for 10 min at 6,000 rpm at 4° C. (For IgA screens, 10 µg of purified IgAs were used and these captured with biotinylated anti-human-IgG secondary antibodies). Cells were washed once with 1 ml LB and then re-suspended in 100 µl LB medium. 10 µl of MACS microbeads coupled to streptavidin (Miltenyi Biotech, Germany) were added and the incubation continued for 20 min at 4° C. Thereafter 900 µl of LB medium was added and the MACS microbead cell suspension was loaded onto the equilibrated MS column (Miltenyi Biotech, Germany) which was fixed to the magnet. (The MS columns were equilibrated by washing once with 1 ml 70% EtOH and twice with 2 ml LB medium.)

The column was then washed three times with 3 ml LB medium. After removal of the magnet, cells were eluted by washing with 2 ml LB medium. After washing the column with 3 ml LB medium, the 2 ml eluate was loaded a second time on the same column and the washing and elution process repeated. The loading, washing and elution process was performed a third time, resulting in a final eluate of 2 ml.

A second round of screening was performed as follows. The cells from the final eluate were collected by centrifugation and re-suspended in 1 ml LB medium supplemented with 50 µg/ml Kanamycin. The culture was incubated at 37° C. for 90 min and then induced with 1 mM IPTG for 30 min. Cells were subsequently collected, washed once with 1 ml LB medium and suspended in 10 µl LB medium. Since the volume was reduced, 1 µg of human, biotinylated IgGs was added and the suspension incubated over night at 4° C. with gentle shaking. All further steps were exactly the same as in the first selection round. Cells selected after two rounds of selection were plated onto LB-agar plates supplemented with 50 µg/ml Kanamycin and grown over night at 37° C.

Evaluation of selected clones by sequencing and Western blot analysis. Selected clones were grown over night at 37° C. in 3 ml LB medium supplemented with 50 µg/ml Kanamycin to prepare plasmid DNA using standard procedures. Sequencing was performed at MWG (Germany) or in collaboration with TIGR (U.S.A.).

For Western blot analysis approximately 10 to 20 µg of total cellular protein was separated by 10% SDS-PAGE and blotted onto HybondC membrane (Amersham Pharmacia Biotech, England). The LamB, BtuB or FhuA fusion proteins were detected using human serum as the primary antibody at a dilution of approximately 1:5,000 and anti-human IgG or IgA antibodies coupled to HRP at a dilution of 1:5,000 as secondary antibodies. Detection was performed using the ECL detection kit (Amersham Pharmacia Biotech, England). Alternatively, rabbit anti FhuA or mouse anti LamB antibodies were used as primary antibodies in combination with the respective secondary antibodies coupled to HRP for the detection of the fusion proteins.

Results

Screening of bacterial surface display libraries by magnetic activated cell sorting (MACS) using biotinylated Igs. The libraries LSPy70 in pMAL9.1, LSPy150 in pMAL10.1 and LSPy300 in pHIE11 were screened with pools of biotinylated, human IgGs and IgAs from patient sera or sera from healthy individuals (see Example 1: Preparation: of antibodies front human serum). The selection procedure was performed as described under Experimental procedures. FIG. 3A shows a representative example of a screen with the LSPy-70 library and P4-IgGs. As can be seen from the colony count after the first selection cycle from MACS screening, the total number of cells recovered at the end is drastically reduced from $3 \times 10^7$ cells to approximately $5 \times 10^4$ cells, whereas the selection without antibodies added showed a reduction to about $2 \times 10^3$ cells (FIG. 3A). After the second round, a similar number of cells was recovered with P4-IgG, while fewer than 10 cells were recovered when no IgGs from human serum were added, clearly showing that selection was dependent on S. pyogenes specific antibodies. To evaluate the performance of the screen, approximately 50 selected clones were picked randomly and subjected to Western blot analysis with the same, pooled serum (FIG. 3B). This analysis revealed that 70% of the selected clones showed reactivity with antibodies present in the relevant serum whereas the control strain expressing LamB without a S. pyogenes specific insert did not react with the same serum. In general, the rate of reactivity was observed to lie within the range of 35 to 75%. Colony PCR analysis showed that all selected clones contained an insert in the expected size range.

Subsequent sequencing of a larger number of randomly picked clones (600 to 1200 per screen) led to the identification of the gene and the corresponding peptide or protein sequence that was specifically recognized by the human serum used for screening. The frequency with which a specific done is selected reflects at least in part the abundance and/or affinity of the specific antibodies in the serum used for selection and recognizing the epitope presented by this done. In that regard it is striking that clones derived from some ORFs (e.g. Spy0433, Spy2025) were picked more than 80 times, indicating their highly immunogenic property. Table 1 summarizes the data obtained for all 15 performed screens. All clones that are presented in Table 1 have been verified by Western blot analysis using whole cellular extracts from single clones to show the indicated reactivity with the pool of human serum used in the respective screen. As can be seen from Table 1, distinct regions of the identified ORF are identified as immunogenic, since variably sized fragments of the proteins are displayed on the surface by the platform proteins.

It is further worth noticing that most of the genes identified by the bacterial surface display screen encode proteins that are either attached to the surface of S. pyogenes and/or are secreted. This is in accordance with the expected role of surface attached or secreted proteins in virulence of S. pyogenes.

Example 4

Assessment of the Reactivity of Highly Immunogenic Peptide Sequences with Individual Human Sera Approximately 100 patients and 60 healthy adult sera were included in the analysis. Following the bioinformatic analysis of selected clones, corresponding peptides were designed and synthesized. In case of epitopes with more than 28 amino acid residues, overlapping peptides were made. All peptides were synthesized with a N-terminal biotin-tag and used as coating reagents on Streptavidin-coated ELISA plates.

The analysis was performed in two steps. First, peptides were selected based on their reactivity with the individual sera, which were included in the serum pools (five individual sera) used for preparations of IgG and IgA screening reagents for bacterial surface display. Peptides not displaying a positive reaction were not included in further, more detailed studies. Second, a large number of not pre-selected individual sera from patients with acute pharyngitis or with post-streptococcal diseases or from healthy adults and children were tested against the peptides showing specific and high reactivity with the screening sera. Antibody levels were measured by ELISA and compared by the score calculated for each peptide based on the number of positive sera and the extent of reactivity. An example for serum reactivity of 174 peptides representing S. pyogenes epitopes from the genomic screen with 20 human sera (representing 4 different pools of five sera) used for the antigen identification is shown in table 2. The peptides range from highly and widely reactive to weakly positive ones. Among the most reactive ones there are known antigens, some of them are also protective in animal challenge models for nasopharyngeal carriage (eg. C5a peptidase and M protein).

Example 5

Gene Distribution Studies with Highly Immunogenic Proteins Identified from S. pyogenes Gene distribution of group A streptococcal antigens by PCR. An ideal vaccine antigen would be an antigen that is present in all, or the vast majority of strains of the target organism to which the vaccine is directed. In order to establish whether the genes encoding the identified Streptococcus pyogenes antigens occur ubiquitously in *S. pyogenes* strains, PCR was performed on a series of independent *S. pyogenes* isolates with primers specific for the gene of interest. *S. pyogenes* isolates were obtained covering emm types most frequently present in patients as shown in FIG. 4A. Oligonucleotide sequences as primers were designed for all identified ORFs yielding products of approximately 1,000 bp, if possible covering all identified immunogenic epitopes. Genomic DNA of all *S. pyogenes* strains was prepared as described under Example 2. PCR was performed in a reaction volume of 25 μl using Taq polymerase (1U), 200 nM dNTPs, 10 pMol of each oligonucleotide and the kit according to the manufacturers instructions (Invitrogen, The Netherlands). As standard, 30 cycles (1×: 5 min. 95° C., 30×: 30 sec. 95° C., 30 sec. 56° C., 30 sec. 72° C., 1×4 min. 72° C.) were performed, unless conditions had to be adapted for individual primer pairs.

Results

All identified genes encoding immunogenic proteins were tested by PCR for their presence in 50 different strains of *S. pyogenes* (FIG. 4A). As an example, FIG. 4B shows the PCR reaction for Spy0269 with all indicated 50 strains. As clearly visible, the gene is present in all strains analysed. The PCR fragment from strain no 8 (M89) was sequenced and showed that of 917 bp only 2 bp are different as compared to the *S. pyogenes* M1 strain SF310, resulting in only one amino acid difference between the two isolates. From a total of 96 genes analysed, 70 were present in all strains tested, while 22 genes were absent in more than 10 of the tested 50 strains (Table 3). Several genes (Spy0433, Spy0681) showed variation in size and were not present in all strain isolates. Some genes showed variation in size, but were otherwise conserved in all tested strains (e.g. Spy1371). Sequencing of the generated PCR fragment from one strain and subsequent comparison to the M1 strain confirmed the amplification of the correct DNA fragment and revealed a degree of sequence divergence as indicated in Table 3. Importantly, many of the identified antigens are well conserved in all strains in sequence and size and are therefore novel vaccine candidates to prevent infections by group A *streptococci*.

Example 6

Characterization of Immune Sera Obtained from Mice Immunized with Highly Immunogenic Proteins/Peptides from *S. pyogenes* Displayed on the Surface of *E. coli*

Generation of Immune Sera from Mice

*E. coli* clones harboring plasmids encoding the platform protein fused to a *S. pyogenes* peptide, were grown in LB medium supplemented with 50 μg/ml Kanamycin at 37° C. Overnight cultures were diluted 1:10, grown until an $OD_{600}$ of 0.5 and induced with 0.2 mM IPTG for 2 hours. Pelleted bacterial cells were suspended in PBS buffer and disrupted by sonication on ice, generating a crude cell extract. According to the $OD_{600}$ measurement, an aliquot corresponding to $5 \times 10^7$ cells was injected into NMRI mice i.v., followed by a boost after 2 weeks. Serum was taken 1 week after the second injection. Epitope specific antibody levels were measured by peptide ELISA.

In vitro Expression of Antigens

Expression of antigens by in vitro grown *S. pyogenes* SF370/M1 was tested by immunoblotting. Different growth media and culture conditions were tested to detect the presence of antigens in total lysates and bacterial culture supernatants. Expression was considered confirmed when a specific band corresponding to the predicted molecular weight and electrophoretic mobility was detected.

Cell Surface Staining

Flow cytometric analysis was carried out as follows. Bacteria were grown under culture conditions, which resulted in expression of the antigen as shown by the immunoblot analysis. Cells were washed twice in Hanks Balanced Salt Solution (HBSS) and the cell density was adjusted to approximately $1 \times 10^6$ CFU in 100 μa HBSS, 0.5% BSA. After incubation for 30 to 60 min at 4° C. with antisera diluted 50 to 100-fold, unbound antibodies were washed away by centrifugation in excess HBSS, 0.5% BSA. Secondary goat anti-mouse antibody ($F(ab')_2$ fragment specific) labeled with fluorescein (FITC) was incubated with the cells at 4° C. for 30 to 60 min. After washing the cells, antibodies were fixed with 2% paraformaldehyde. Bound antibodies were detected using a Becton Dickinson FACScan flow cytometer and data further analyzed with the computer program CELLQuest. Control sera included mouse pre-immune serum and mouse polyclonal serum generated with lysates prepared from IPTG induced *E. coli* cells transformed with plasmids encoding the genes lamB or fhuA without *S. pyogenes* genomic insert.

Opsonophagocytosis Assay

Epitope specific immune sera were tested for their activity to induce opsonophagocytosis in a FACS based assay. Sera were heat inactivated and anti-*E. coli* antibodies then removed by incubation with whole cell *E. coli* (3×). $10^7$ Alexa 488 labeled *S. pyogenes* cells were pre-opsonized in the presence of 2-10% immune serum and 2% hamster serum as complement source and then added to $10^6$ phagocytic cells (RAW246.7 or P388.D1 murine monocytic cell lines). The cell mixture was incubated for 30 min at 37° C. Time, IgG concentration and complement dependent uptake of bacteria was registered as an increase in mean fluorescence intensity of the phagocytic cells measured with a fluorescence activated cell sorter.

Bactericidal (Killing) Assay

Murine macrophage cells (RAW246.7 or P388.D1) and bacteria were incubated and the loss of viable bacteria after 60 min was determined by colony counting. In brief, bacteria were washed twice in Hanks Balanced Salt Solution (HBSS) and the cell density was adjusted to approximately $1 \times 10^5$ CFU in 50 μl HBSS. Bacteria were incubated with mouse sera (up to 25%) and guinea pig complement (up to 5%) in a total volume of 100 μl for 60 min at 4° C. Pre-opsonized bacteria were mixed with macrophages (murine cell line RAW264.7 or P388.D1; $2 \times 10^6$ cells per 100 μl) at a 1:20 ratio and were incubated at 37° C. on a rotating shaker at 500 rpm. An aliquot of each sample was diluted in sterile water and incubated for 5 min at room temperature to lyse macrophages. Serial dilutions were then plated onto Todd-Hewitt Broth agar plates. The plates were incubated overnight at 37° C., and the colonies were counted with the Countermat flash colony counter (IUL Instruments). Control sera included mouse pre-immune serum and mouse polyclonal serum generated with lysates prepared from IPTG induced *E. coli* transformed with plasmids harboring the genes lamB or fhuA without *S. pyogenes* genomic insert.

Results

In vitro expression and cell surface staining. The expression of the antigenic proteins was analyzed in vitro in *S. pyogenes* SF370/M1 by using sera raised against *E. coli* clones harboring plasmids encoding the platform protein fused to a *S. pyogenes* peptide. This analysis served as a first step to determine whether a protein is expressed at all in order to evaluate surface expression of the polypeptide by FACS analysis. It was anticipated that not all protein would be expressed under in vitro conditions, but several proteins were detected by Western blot analysis in total cell lysates (e.g. Spy0012, Spy0112, Spy0416, Spy0437, Spy0872, Spy1032, Spy1315, Spy1798; data not shown). Cell surface accessibility for several antigenic proteins was subsequently demonstrated by an assay based on flow cytometry. *streptococci* were incubated with preimmune and polyclonal mouse sera raised against *S. pyogenes* lysate or *E. coli* clones harboring plasmids encoding the platform protein fused to a *S. pyogenes* peptide, follow by detection with fluorescently tagged secondary antibody. As shown in FIG. 5A, antisera raised against *S. pyogenes* lysate cause a shift in fluorescence of the *S. pyogenes* SF370/M1 cell population. Similar cell surface staining of *S. pyogenes* SF370/M1 cells was observed with polyclonal sera raised against peptides of antigen Spy0012 (FIG. 5B), Spy1315 and Spy1798 (FIG. 5C), although only a subpopulation of the bacteria was stained, as indicated by the detection of two peaks. This phenomenon may be a result of differential expression of the gene products during the growth of the bacterium or partial inhibition of antibody binding caused by other surface molecules.

These experiments confirmed the bioinformatic prediction that these proteins are exported due to their signal peptide sequence and in addition showed that they are anchored on the cell surface of *S. pyogenes* SF370/M1. They also confirm that these proteins are available for recognition by human antibodies and make them valuable candidates for the development of a vaccine against Group A Streptococcal disease.

Example 7

Protective Immune Responses Against Infection with Group A *streptococci* upon Immunization with Recombinant Antigens Experimental Procedures
Cloning of Genes Encoding Antigenic Proteins The gene or DNA fragment of interest was amplified from genomic DNA of *S. pyogenes* SF370 by PCR amplification using gene specific primers. Apart from the gene specific sequence, the primers contained additional bases at the respective 5' end consisting of restriction sites that aided in the directional cloning of the amplified PCR product. The gene specific sequence of the primer ranged between 15-24 bases in length. The PCR products obtained were digested with the appropriate restriction enzymes and cloned into the appropriately digested pET28b(+) vector (NOVAGEN). After confirmation of the construction of the recombinant plasmid, *E. coli* BL21 STAR® cells (INVITROGEN) that served as expression hosts were transformed. These cells are optimized to efficiently express the gene of interest as encoded by the pET28b plasmid.

Expression of Antigens in *Escherichia coli*

*E. coli* BL21 STAR® cells harboring the recombinant plasmid were grown into log phase in LB medium supplemented with 50 kg/ml Kanamycin at 37° C. Once an $OD_{600\ nm}$ of 0.8 was reached, the culture was induced with 1 mM IPTG for 3 hours at 37° C. The cells were harvested by centrifugation, lysed by a combination of the freeze-thaw method followed by disruption of cells with the Bug-buster® reagent from NOVAGEN. The lysate was separated by centrifugation into soluble (supernatant) and insoluble (pellet) fractions.

Purification of Recombinant Proteins from *E. coli*

Depending on the localization of the protein, different purification strategies were followed. Proteins in the soluble fraction were purified by binding the supernatant of the cell lysates after cell disruption to Ni-Agarose beads (Ni-NTA-Agarosee, QIAGEN). Due to the presence of the penta-Histidine (HIS) at the C, N or both termini of the expressed protein, the protein binds to Ni-agarose while other contaminating proteins are washed and removed from the column by washing buffer. The proteins were eluted by a solution containing 100 mM imidazole in the appropriate buffer. The eluate was concentrated, assayed by Bradford for protein concentration and analysed by SDS-PAGE and Western blot. Proteins in the insoluble fraction were purified by solubilization of the pellet in an appropriate buffer containing 8 M Urea. The purification was performed under denaturing conditions (in buffer containing 8M Urea) using the same materials and procedure as mentioned above for soluble proteins. The eluate was concentrated and dialyzed to remove all urea in a gradual or stepwise manner. The final protein solution was concentrated, analysed by SDS-PAGE and measured by Bradford method. Expression was considered confirmed when a specific band corresponding to the predicted molecular weight and electrophoretic mobility was detected. For proteins, which precipitated during dialysis due to the removal of the denaturing reagent urea, the insoluble inclusion bodies were washed several times and directly used for immunization of mice.

Immunisation of NMRI Mice with Recombinant Proteins and Challenge with *S. pyogenes* AP1

The immunogenicity of the proteins was assayed in an experimental animal model using NMRI mice and the *S. pyogenes* strain AP1 as infectious agent. Ten female NMRI mice at 7-8 weeks of age were immunized with 50 μg/dose of recombinant protein every 2 weeks for a total of 3 doses. The initial dose was adjuvanted with Complete Freund's adjuvant while the remaining two doses were adjuvanted with Incomplete Freund's adjuvant. At the end of the immunization the mice were bled to check the antibody titer and subsequentely intravenously (i.v.) challenged with a lethal dose of *S. pyogenes* AP1 ($5 \times 10^7$ pathogenic bacteria). The mice were scored for 18 to 21 days post challenge for survival.

Results
Expression and Purification of Recombinant Proteins.

Of the 31 proteins selected for recombinant protein expression, 29 proteins could be produced in *E. coli* to a level sufficient for purification. While some of the proteins could be produced as soluble protein (see Table 4), some proteins turned out to be insoluble (e.g. Spy416B, Spy0872) or precipitated upon dialysis, which was intended to remove the denaturing reagent urea after solubilization of insoluble proteins such as Spy0031, Spy0292, Spy720. In these cases the washed inclusion bodies were directly injected into mice for immunization. In generell, the affinity purification yielded a recombinant protein preparation of at least 85% purity.

Immune Responses after Immunization with Recombinant Proteins in NMRI Mice.

Table 4 lists those antigens, which were tested in mice and showed some degree of protection in experimental animals. Recombinant proteins, which were also tested in the bacteremia model in animals, but did show not any level of protection in the described experiments are not listed here; but include proteins such as Spy0012, Spy1063 and Spy1494. The described bacteremia model evaluates the protective value of vaccine candidates against invasive disease as pathogenic bacteria are directly injected into the blood. Recombinant proteins, which induce antibodies capable of protection against such group A *streptococcal* infection, are considered as valuable candidates for the development of a vaccine against Group A Streptococcal disease. In comparison to the positive control Spy2018 (M1 protein), which was previously shown to provide protection against *S. pyogenes* challenge, a number of antigens performed to a similar degree when the endpoint of the challenge experiment after 18 or 21 days (Table 4) was assessed (Spy0416, Spy1607 or Spy0292). Other proteins showed only a partial protective effect (Spy0720, Spy0872), but may prove very effective when combined with other antigens (FIG. 6). Surprisingly, the antigen screen had identified immunogenic epitopes predominantly in the first half of the two larger proteins, Spy0416 and Spy1972. Therefore it was reasoned that the protective region may also be contained in the N terminal part of the protein. In case of Spy0416, both parts of the antigen were produced as recombinant protein (Spy0416A and Spy0416B; see Table4) and tested in animal experiments. The experiments showed that only the first half of the protein Spy0416 (Table 4; Spy0416A) provided protection in the animal model, while the second half of the protein (Spy0416B) had no protective effect at all, clearly delineating a smaller region within the protein as the vaccine candidate. For antigen Spy1972 only the first half of the full-length protein was produced as recombinant protein and tested in the animal model.

Example 8

Variability of Genes Encoding Antigenic Proteins in *S. pyogenes* Strains of Various Serotypes Experimental Procedures Sequencing of PCR fragments and Bioinformatic Analysis.

The PCR analysis of *S. pyogenes* strains is described in Example 5. The sequencing of the PCR fragments provided an estimate of the variability of the gene and the summary of the results are listed in Table 3. The availability of genomic sequences from five *Streptococcus pyogenes* strains (SF370: M1; MGAS8232: M18; SSI-1: M3; MGAS315: M3; Manfredo: M5) allowed a further assessment of the variability of the antigens. All sequences were aligned with the respective antigen sequence from *S. pyogenes* SF370 and those amino acid residues identified which differed from the ones in the antigenic protein from *S. pyogenes* SF370. Inserted or deleted sequences were detected in some of the antigenic proteins, but are not contained in this analysis.

Results

Table 5 shows all positions that were identified to be variable in the indicated antigens in one of the four *S. pyogenes* strains (MGAS8232: M18; SSI-1: M3; MGAS315: M3; Manfredo: M5) or the strain used for sequencing of the amplified PCR fragment (see Table 3). The bioinformatic analysis shows that some of the antigenic proteins are very well conserved without a single amino exchange in any of the six strains of serotypes M1, M3, M5, M18 and M89. Proteins belonging to this group include Spy0103 and Spy1536, while the exchanges in the other antigenic proteins are more numerous in larger proteins than in smaller ones, as expected from the difference in size by itself. Although a variety of strains was analysed, it was almost never observed that a single residue was changed to more than one other amino acid in the other strains. A further analysis of sequences of the respective genes in a larger number of strains of varying serotypes, clinical indication or geographic location would certainly identify possible changes in those amino acid residues listed or in additional residues.

Only one of the antigenic proteins analysed by the alignment of six gene sequences showed a considerable degree of variation in size (Spy1357: SF370-217 amino acids; MGAS8232-245 aa; SSI-1-329 aa; MGAS315-329 aa; Manfredo-279 aa). Thus it is evident, that most of the evaluated antigens are very well conserved in sequence as well as in size and provide promising candidates for vaccine development.

REFERENCES

Altschul, S., et al. (1990). *Journal of Molecular Biology* 215: 403-10.
Bennett, D., et al. (1995). *J Mol Recognit* 8: 52-8.
Bessen, D., et al. (1988). *Infect Immun* 56: 2666-2672.
Bisno, A., et al. (1987). *Infect Immun* 55: 753-7.
Bronze, M., et al. (1988). *J Immunol* 141:2767-2770.
Clackson, T., et al. (1991). *Nature* 352: 624-8.
Cone, L., et al. (1987). *New Engl J Med* 317: 146-9.
Cunningham, M. (2000). *Clin Microbiol Rev* 13:470-511.
Devereux, J., et al. (1984). *Nucleic acids research* 12: 387-95.
Doherty, E., et al. (2001). *Annu Rev Biophys Biomol Struct* 30:457-475.
Eisenbraun, M., et al. (1993). *DNA Cell Biol* 12: 791-7.
Enright M., et al. (2001) *Inf. Immun.* 69: 2416-27
Etz, H., et al. (2001). *J Bacteriol* 183: 6924-35.
Fenderson, P., et al. (1989). *J Immunol* 142: 2475-2481.
Fischetti, V. (1989). *Clin Microbiol Rev* 2: 285-314.
Ganz, T. (1999). *Science* 286:420-421.
Georgiou, G. (1997). *Nature Biotechnology* 15: 29-34.
Guzman, C., et al. (1999). *J Infect Dis* 179: 901-6.
Hashemzadeh-Bonehi, L., et al. (1998). *Mol Microbiol* 30: 676-678.
Heinje, von G, (1987) e.g. Sequence Analysis in Molecular Biology, Acedimic Press
Hemmer, B., et al. (1999). *Nat Med* 5: 1375-82.
Hoe N., et al. (2001) *J. Inf. Dis.* 183: 633-9
Hope-Simpson, R. (1981). *J Hyg (Lond)* 87:109-29.
Ji, Y., et al. (1997). *Infect Immun* 65: 2080-2087.
Johanson, K., et al. (1995). *J Biol Chem* 270:9459-71.
Jones, P., et al. (1986). *Nature* 321:522-5.
Kajava, A., et al. (2000). *J Bacteriol* 182: 2163-9.
Kohler, G., et al. (1975). *Nature* 256: 495-7.
Kolaskar, A., et al. (1990). *FEBS Lett* 276: 172-4.
Lee, P. K (1989). *J Clin Microbiol* 27: 1890-2.
Lewin, A., et al. (2001). *Trends Mol Med* 7:221-8.
Marks, J., et al. (1992). *Biotechnology (N Y)* 10: 779-83.
McCafferty, J., et al. (1990). *Nature* 348: 552-4.
Okano, H., et al. (1991). *J Neurochem* 56:560-7.
Oligodeoxynucleotides as Antisense Inhibitors of Gene Expression; CRC Press, Boca Ration, Fla. (1988) for a description of these molecules
Phillips-Quagliata, J., et al. (2000). *J Immunol* 165: 2544-55.
Rammensee, H., et al. (1999). *Immunogenetics* 50: 213-9.
Rosenshine, I., et al. (1992). *Infect Immun* 60: 2211-7.
Seeger, C., et al. (1984). *Proc Natl Acad Sci U S A* 81: 5849-52.
Shibuya, A., et al. (2000). *Nature Immunology* 1: 441-6.
Skerra, A. (1994). *Gene* 151: 131-5.
Stevens, D. (1992). *Clin Infect Dis* 14: 2-11.
Tang, D., et al. (1992). *Nature* 356: 152-4.
Tempest, P., et al. (1991). *Biotechnology (N Y)* 9: 266-71.
Tourdot, S., et al. (2000). *Eur J Immunol* 30: 3411-21.
Whitnack, E., et al. (1985). *J Exp Med* 162: 1983-97.
Wiley, J., et al. (1987) Current Protocols in Molecular Biology
Vitali, L., et al. (2002) *J. Clin. Microbiol* 40:679-681

TABLE 1

Immunogenic proteins identified by bacterial surface display.

| S. pyogenes antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| Spy0012 | Hypothetical protein | 4-44, 57-65, 67-98, 101-107, 109-125, 131-144, 146-159, 168-173, 181-186, 191-200, 206-213, 229-245, 261-269, 288-301, 304-317, 323-328, 350-361, 374-384, 388-407, 416-425 | A: 12, I: 5, N: 2 | 1-114 | 1, 151 |
| Spy0019 | putative secreted protein (cell division and antibiotic tolerance) | 5-17, 49-64, 77-82, 87-98, 118-125, 127-140, 142-150, 153-159, 191-207, 212-218, 226-270, 274-287, 297-306, 325-331, 340-347, 352-369, 377-382, 390-395 | F: 2, I: 16, K: 24, N: 29, P: 12 | 29-226 | 2, 152 |
| Spy0025 | putative phosphoribosylformyl glycinamidine synthase II | 4-16, 20-26, 32-74, 76-87, 93-108, 116-141, 148-162, 165-180, 206-219, 221-228, 230-236, 239-245, 257-268, 313-328, 330-335, 353-359, 367-375, 394-403, 414-434, 437-444, 446-453, 456-464, 478-487, 526-535, 541-552, 568-575, 577-584, 589-598, 610-618, 624-643, 653-665, 667-681, 697-718, 730-748, 755-761, 773-794, 806-821, 823-831, 837-845, 862-877, 879-889, 896-919, 924-930, 935-940, 947-955, 959-964, 969-986, 991-1002, 1012-1036, 1047-1056, 1067-1073, 1079-1085, 1088-1111, 1130-1135, 1148-1164, 1166-1173, 1185-1192, 1244-1254 | D: 3 | 919-929 | 3, 153 |
| Spy0031 | putative choline binding protein | 5-44, 62-74, 78-83, 99-105, 107-113, 124-134, 161-174, 176-194, 203-211, 216-237, 241-247, 253-266, 272-299, 323-349, 353-360 | I: 3, K: 3, N: 3 | 145-305 | 4, 154 |
| Spy0103 | putative competence protein | 15-39, 52-61, 72-81, 92-97 | A: 8 | 71-81 | 5, 155 |
| Spy0112 | putative pyrroline carboxylate reductase | 13-19, 21-31, 40-108, 115-122, 125-140, 158-180, 187-203, 210-223, 235-245 | B: 4 | 173-186 | 6, 156 |
| Spy0115 | putative glutamyl-aminopeptidase | 5-12, 19-27, 29-39, 59-67, 71-78, 80-88, 92-104, 107-124, 129-142, 158-168, 185-191, 218-226, 230-243, 256-267, 272-277, 283-291, 307-325, 331-344, 346-352 | A: 3, C: 26 | 316-331 | 7, 157 |
| Spy0166 | Hypothetical protein | 6-28, 43-53, 60-76, 93-103 | I: 22, K: 7, N: 17, O: 31, P: 5 | 21-99 | 8, 158 |
| Spy0167 | Streptolysin O | 10-30, 120-126, 145-151, 159-169, 174-182, 191-196, 201-206, 214-220, 222-232, 254-272, 292-307, 313-323, 332-353, 361-369, 389-396, 401-415, 428-439, 465-481, 510-517, 560-568 | A: 118, B: 14, C: 18, D: 37, F: 141, G: 79, H: 92, L: 97, K: 123, L: 5, M: 21, N: 225, O: 230, P: 265 | 9-264 | 9, 159 |
| Spy0168 | Hypothetical protein | 5-29, 39-45, 107-128 | K: 4, N: 7 | 1-112 | 10, 160 |
| Spy0171 | hypothetical protein | 4-38, 42-50, 54-60, 65-71, 91-102 | H: 2 | 21-56 | 11, 161 |
| Spy0183 | putative glycine betaine/proline ABC transporter | 4-13, 19-25, 41-51, 54-62, 68-75, 79-89, 109-122, 130-136, 172-189, 192-198, 217-224, 262-268, 270-276, 281-298, 315-324, 333-342, 353-370, 376-391 | C: 6 | 23-39 | 12, 162 |
| Spy0230 | putative ABC transporter (ATP-binding protein) | 6-41, 49-58, 62-103, 117-124, 147-166, 173-194, 204-211, 221-229, 255-261, 269-284, 288-310, 319-325, 348-380, 383-389, 402-410, 424-443, 467-479, 496-517, 535-553, 555-565, 574-581, 583-591 | C: 46 | 474-489 | 13, 163 |
| Spy0269 | putative surface exclusion protein | 8-35, 52-57, 66-73, 81-88, 108-114, 125-131, 160-167, 174-180, 230-235, 237-249, 254-262, 278-285, 308-314, 321-326, 344-353, 358-372, 376-383, 393-411, 439-446, 453-464, 471-480, 485-492, 502-508, 523-529, 533-556, 558-563, 567-584, 589-597, 605-619, 625-645, 647-666, 671-678, 690-714, 721-728, 741-763, 766-773, 777-787, 792-802, 809-823, 849-864 | A: 2, B: 12, D: 3, F: 11, H: 5, N: 6 | 37-241 409-534 582-604 743-804 | 14, 164 |
| Spy0287 | conserved hypothetical protein | 4-17, 24-36, 38-44, 59-67, 72-90, 92-121, 126-149, 151-159, 161-175, 197-215, 217-227, 241-247, 257-264, 266-275, 277-284, 293-307, 315-321, 330-337, 345-350, 357-366, 385-416 | K: 1 | 202-337 | 15, 165 |
| Spy0292 | penicillin-binding protein (D-alanyl-D-alanine car | 4-20, 22-46, 49-70, 80-89, 96-103, 105-119, 123-129, 153-160, 181-223, 227-233, 236-243, 248-255, 261-269, 274-279, 283-299, 305-313, 315-332, 339-344, 349-362, 365-373, 380-388, 391-397, 402-407 | F: 2 | 1-48 | 16, 166 |
| Spy0295 | oligopeptidepermease | 18-37, 41-63, 100-106, 109-151, 153-167, 170-197, 199-207, 212-229, 232-253, 273-297 | A: 3 | 203-217 | 17, 167 |
| Spy0348 | putative aminodeoxychorismate lyase | 20-26, 54-61, 80-88, 94-101, 113-119, 128-136, 138-144, 156-188, 193-201, 209-217, 221-229, 239-244, 251-257, 270-278, 281-290, 308-315, 319-332, 339-352, 370-381, 388-400, 411-417, 426-435, 468-482, 488-497, 499-506, 512-521 | D: 5, I: 3, M: 3, P: 3 | 261-273 | 18, 168 |

TABLE 1-continued

Immunogenic proteins identified by bacterial surface display.

| S. pyogenes antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| Spy0416 | putative cell envelope serine proteinase | 6-12, 16-36, 50-56, 86-92, 115-125, 143-152, 163-172, 193-203, 235-244, 280-289, 302-315, 325-348, 370-379, 399-405, 411-417, 419-429, 441-449, 463-472, 482-490, 500-516, 536-543, 561-569, 587-594, 620-636, 647-653, 659-664, 677-685, 687-693, 713-719, 733-740, 746-754, 756-779, 792-799, 808-817, 822-828, 851-865, 902-908, 920-938, 946-952, 969-976, 988-1005, 1018-1027, 1045-1057, 1063-1069, 1071-1078, 1090-1099, 1101-1109, 1113-1127, 1130-1137, 1162-1174, 1211-1221, 1234-1242, 1261-1268, 1278-1284, 1312-1317, 1319-1326, 1345-1353, 1366-1378, 1382-1394, 1396-1413, 1415-1424, 1442-1457, 1467-1474, 1482-1490, 1492-1530, 1537-1549, 1559-1576, 1611-1616, 1624-1641 | A: 3, B: 4, C: 30, D: 13, F: 138, G: 120, H: 101, I: 9, K: 14, M: 2, N: 15, O: 8, P: 19 | 1-414 443-614 997-1392 | 19, 169 |
| Spy0430 | hypothetical protein | 14-42, 70-75, 90-100, 158-181 | B: 7, I: 10, P: 18 | 1-164 | 20, 170 |
| Spy0433 | hypothetical protein | 4-21, 30-36, 54-82, 89-97, 105-118, 138-147 | A: 138, B: 8, C: 67, D: 11, E: 13, F: 35, G: 10, H: 5, M: 8 | 126-207 | 21, 171 |
| Spy0437 | Hypothetical protein | 4-21, 31-66, 96-104, 106-113, 131-142 | A: 29, B: 10, C: 21, D: 24, E: 15 | 180-204 | 22, 172 |
| Spy0469 | putative 42 kDa protein | 5-23, 31-36, 38-55, 65-74, 79-88, 101-129, 131-154, 156-165, 183-194, 225-237, 245-261, 264-271, 279-284, 287-297, 313-319, 327-336, 343-363, 380-386 | B: 5, F: 77, I: 8, K: 15, M: 3, N: 17, O: 20 | 11-197 204-219 258-372 | 23, 173 |
| Spy0488 | hypothetical protein | 4-20, 34-41, 71-86, 100-110, 113-124, 133-143, 150-158, 160-166, 175-182, 191-197, 213-223, 233-239, 259-278, 298-322 | A: 17, B: 11, C: 23, D: 12, E: 4, G: 4, H: 7 | 195-289 | 24, 174 |
| Spy0515 | Putative sugar transferase | 4-10, 21-35, 44-52, 54-62, 67-73, 87-103, 106-135, 161-174, 177-192, 200-209, 216-223, 249-298, 304-312, 315-329 | B: 5, I: 3 | 12-130 | 25, 175 |
| Spy0580 | conserved hypothetical protein | 10-27, 33-38, 48-55, 70-76, 96-107, 119-133, 141-147, 151-165, 183-190, 197-210, 228-236, 245-250, 266-272, 289-295, 297-306, 308-315, 323-352, 357-371, 381-390, 394-401, 404-415, 417-425, 427-462, 466-483, 485-496, 502-507, 520-529, 531-541, 553-570, 577-588, 591-596, 600-610, 619-632, 642-665, 671-692, 694-707 | C: 5 | 434-444 | 26, 176 |
| Spy0621 | conserved hypothetical protein | 6-14, 16-25, 36-46, 52-70, 83-111, 129-138, 140-149, 153-166, 169-181, 188-206, 212-220, 223-259, 261-269, 274-282, 286-293, 297-306, 313-319, 329-341, 343-359, 377-390, 409-415, 425-430 | C: 3 | 360-375 | 27, 177 |
| Spy0630 | putative PTS dependent N-acetyl-galactosamine-IIC | 4-26, 28-48, 54-62, 88-121, 147-162, 164-201, 203-237, 245-251 | C: 2 | 254-260 | 28, 178 |
| Spy0681 | hypothetical protein, phage associated | 12-21, 26-32, 66-72, 87-93, 98-112, 125-149, 179-203, 209-226, 233-242, 249-261, 266-271, 273-289, 293-318, 346-354, 360-371, 391-400 | A: 8 | 369-382 | 29, 179 |
| Spy0683 | putative minor capsid protein, phage associated | 11-38, 44-65, 70-87, 129-135, 140-163, 171-177, 225-232, 238-249, 258-266, 271-280, 284-291, 295-300, 329-337, 344-352, 405-412, 416-424, 426-434, 436-455, 462-475, 478-487 | B: 11, D: 4 | 270-312 | 30, 180 |
| Spy0702 | Hypothetical protein | 5-17, 34-45, 59-69, 82-88, 117-129, 137-142, 158-165, 180-195, 201-206, 219-226, 241-260, 269-279, 292-305, 312-321, 341-347, 362-381, 396-410, 413-432, 434-445, 447-453, 482-487, 492-499, 507-516, 546-552, 556-565, 587-604 | L: 2 | 486-598 | 31, 181 |
| Spy0710 | conserved hypothetical protein, phage associated | 4-15, 17-32, 40-47, 67-78, 90-98, 101-107, 111-136, 161-171, 184-198, 208-214, 234-245, 247-254, 272-279, 288-298, 303-310, 315-320, 327-333, 338-349, 364-374 | B: 10 | 378-396 | 32, 182 |
| Spy0711 | pyrogenic exotoxin C precursor, phage associated (speC) | 5-27, 33-49, 51-57, 74-81, 95-107, 130-137, 148-157, 173-184 | K: 2 | 75-235 | 33, 183 |
| Spy0720 | conserved hypothetical protein | 6-23, 47-53, 57-63, 75-82, 97-105, 113-122, 124-134, 142-153, 159-164, 169-179, 181-187, 192-208, 215-243, 247-257, 285-290, 303-310 | D: 2 | 30-51 | 34, 184 |
| Spy0727 | putative DNA gyrase, subunit B | 17-29, 44-52, 59-73, 77-83, 86-92, 97-110, 118-153, 156-166, 173-179, 192-209, 225-231, 234-240, 245-251, 260-268, 274-279, 297-306, 328-340, 353-360, 369-382, 384-397, 414-423, 431-436, 452-465, 492-498, 500-508, 516-552, 554-560, 568-574, 580-586, 609-617, 620-626, 641-647 | M: 26 | 208-219 | 35, 185 |

TABLE 1-continued

Immunogenic proteins identified by bacterial surface display.

| S. pyogenes antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| Spy0737 | putative extracellular matrix binding protein | 4-26, 32-45, 58-72, 111-119, 137-143, 146-159, 187-193, 221-231, 235-242, 250-273, 290-304, 311-321, 326-339, 341-347, 354-368, 397-403, 412-419, 426-432, 487-506, 580-592, 619-628, 663-685, 707-716, 743-751, 770-776, 787-792, 850-859, 866-873, 882-888, 922-931, 957-963, 975-981, 983-989, 1000-1008, 1023-1029, 1058-1064, 1089-1099, 1107-1114, 1139-1145, 1147-1156, 1217-1226, 1276-1281, 1329-1335, 1355-1366, 1382-1394, 1410-1416, 1418-1424, 1443-1451, 1461-1469, 1483-1489, 1491-1501, 1515-1522, 1538-1544, 1549-1561, 1587-1593, 1603-1613, 1625-1630, 1636-1641, 1684-1690, 1706-1723, 1765-1771, 1787-1804, 1850-1857, 1863-1894, 1897-1910, 1926-1935, 1937-1943, 1960-1983, 1991-2005, 2008-2014, 2018-2039 | B: 5, E: 3, K: 11 | 396-533 1342-1502 1672-1920 | 36, 186 |
| Spy0747 | extracellular nuclease | 4-25, 45-50, 53-65, 79-85, 87-92, 99-109, 126-137, 141-148, 156-183, 190-203, 212-217, 221-228, 235-242, 247-277, 287-293, 300-319, 321-330, 341-361, 378-389, 394-406, 437-449, 455-461, 472-478, 482-491, 507-522, 544-554, 576-582, 587-593, 611-621, 626-632, 649-661, 679-685, 696-704, 706-716, 726-736, 740-751, 759-766, 786-792, 797-802, 810-822, 824-832, 843-852, 863-869, 874-879, 882-905 | A: 72, B: 17, H: 6, O: 3 | 1-113 210-232 250-423 536-564 | 37, 187 |
| Spy0777 | putative ATP-dependent exonuclease, subunit A | 4-16, 33-39, 43-49, 54-85, 107-123, 131-147, 157-169, 177-187, 198-209, 220-230, 238-248, 277-286, 293-301, 303-315, 319-379, 383-393, 402-414, 426-432, 439-449, 470-478, 483-497, 502-535, 552-566, 571-582, 596-601, 608-620, 631-643, 651-656, 663-678, 680-699, 705-717, 724-732, 738-748, 756-763, 766-772, 776-791, 796-810, 819-827, 829-841, 847-861, 866-871, 876-882, 887-894, 909-934, 941-947, 957-969, 986-994, 998-1028, 1033-1070, 1073-1080, 1090-1096, 1098-1132, 1134-1159, 1164-1172, 1174-1201 | C: 4, E: 2 | 617-635 | 38, 188 |
| Spy0789 | putative ABC-transporter (permease protein | 7-25, 30-40, 42-64, 70-77, 85-118, 120-166, 169-199, 202-213, 222-244 | A: 3 | 190-203 | 39, 189 |
| Spy0839 | putative glycerophosphodiester phosphodieste | 4-11, 15-53, 55-93, 95-113, 120-159, 164-200, 210-243, 250-258, 261-283, 298-319, 327-340, 356-366, 369-376, 380-386, 394-406, 409-421, 425-435, 442-454, 461-472, 480-490, 494-505, 507-514, 521-527, 533-544, 566-574 | A: 7, D: 2 | 385-398 | 40, 190 |
| Spy0843 | cell surface protein | 5-36, 66-72, 120-127, 146-152, 159-168, 172-184, 205-210, 221-232, 234-243, 251-275, 295-305, 325-332, 367-373, 470-479, 482-487, 520-548, 592-600, 605-615, 627-642, 655-662, 664-698, 718-725, 734-763, 776-784, 798-809, 811-842, 845-852, 867-872, 879-888, 900-928, 933-940, 972-977, 982-1003 | A: 11, B: 3, C: 5, D: 4, F: 50, H: 19, G: 49, L: 112, K: 102, L: 10, M: 3, N: 213, O: 188, P: 310 | 12-190 276-283 666-806 | 41, 191 |
| Spy0872 | putative secreted 5'-nucleotidase | 4-38, 63-68, 100-114, 160-173, 183-192, 195-210, 212-219, 221-238, 240-256, 258-266, 274-290, 301-311, 313-319, 332-341, 357-363, 395-401, 405-410, 420-426, 435-450, 453-461, 468-475, 491-498, 510-518, 529-537, 545-552, 585-592, 602-611, 634-639, 650-664 | A: 6, D: 2, F: 5, H: 14, I: 9, K: 10, L: 1, N: 16, O: 12 | 30-80 89-105 111-151 | 42, 192 |
| Spy0895 | histidine protein kinase | 7-29, 31-39, 47-54, 63-74, 81-94, 97-117, 122-127, 146-157, 168-192, 195-204, 216-240, 251-259 | C: 11 | 195-203 | 43, 193 |
| Spy0972 | putative terminase, large subunit - phage | 5-16, 28-34, 46-65, 79-94, 98-105, 107-113, 120-134, 147-158, 163-172, 180-186, 226-233, 237-251, 253-259, 275-285, 287-294, 302-308, 315-321, 334-344, 360-371, 399-412, 420-426 | B: 2 | 32-50 | 44, 194 |
| Spy0981 | hypothetical protein - phage associated | 8-20, 30-36, 71-79, 90-96, 106-117, 125-138, 141-147, 166-174 | A: 7, B: 2 | 75-90 | 45, 195 |
| Spy1008 | streptococcal exotoxin H precursor (speH) | 4-13, 15-33, 43-52, 63-85, 98-114, 131-139, 146-174, 186-192, 198-206, 227-233 | C: 11 | 69-88 | 46, 196 |
| Spy1032 | extracellular hyaluronate lyase | 4-22, 29-35, 59-68, 153-170, 213-219, 224-238, 240-246, 263-270, 285-292, 301-321, 327-346, 356-371, 389-405, 411-418, 421-427, 430-437, 450-467, 472-477, 482-487, 513-518, 531-538, 569-576, 606-614, 637-657, 662-667, 673-690, 743-753, 760-767, 770-777, 786-802 | B: 3, K: 3, M: 5 | 96-230 361-491 572-585 | 47, 197 |

TABLE 1-continued

Immunogenic proteins identified by bacterial surface display.

| S. pyogenes antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| Spy1054 | putative collagen-like protein (SclC) | 4-12, 21-36, 48-55, 74-82, 121-127, 195-203, 207-228, 247-262, 269-278, 280-289 | A: 71, B: 13, C: 233, D: 41, E: 163, F: 200, G: 442, H: 129, N: 3 | 102-210 | 48, 198 |
| Spy1063 | putative periplasmic-iron-binding protein | 13-20, 23-31, 38-44, 78-107, 110-118, 122-144, 151-164, 176-182, 190-198, 209-216, 219-243, 251-256, 289-304, 306-313 | A: 4 | 240-248 | 49, 199 |
| Spy1162 | putative ribonuclease HII | 5-26, 34-48, 57-77, 84-102, 116-132, 139-145, 150-162, 165-173, 176-187, 192-205, 216-221, 234-248, 250-260 | B: 3, C: 5 | 182-198 | 50, 200 |
| Spy1206 | putative ABC transporter | 10-19, 26-44, 53-62, 69-87, 90-96, 121-127, 141-146, 148-158, 175-193, 204-259, 307-313, 334-348, 360-365, 370-401, 411-439, 441-450, 455-462, 467-472, 488-504 | A: 2 | 41-56 | 51, 201 |
| Spy1228 | Putative lipoprotein | 5-21, 36-42, 90-116, 123-130, 138-144, 146-157, 184-201, 213-228, 252-259, 277-297, 308-313, 318-323, 327-333 | M: 33 | 202-217 | 52, 202 |
| Spy1245 | putative phosphate ABC transporter | 6-26, 33-51, 72-90, 97-131, 147-154, 164-171, 187-216, 231-236, 260-269, 275-283 | I: 3, K: 3 | 1-127 | 53, 203 |
| Spy1315 | hypothetical protein | 4-22, 24-38, 44-58, 72-88, 99-108, 110-117, 123-129, 131-137, 142-147, 167-178, 181-190, 206-214, 217-223, 271-282, 290-305, 320-327, 329-336, 343-352, 354-364, 396-402, 425-434, 451-456, 471-477, 485-491, 515-541, 544-583, 595-609, 611-626, 644-656, 660-681, 683-691, 695-718 | B: 4 | 297-458 | 54, 204 |
| Spy1357 | protein GRAB (protein G-related alpha 2M-binding p | 5-43, 92-102, 107-116, 120-130, 137-144, 155-163, 169-174, 193-213 | G: 27, H: 8, K: 2, N: 4 | 24-135 | 55, 205 |
| SPy1361 | putative internalin A precursor | 4-25, 61-69, 73-85, 88-95, 97-109, 111-130, 135-147, 150-157, 159-179, 182-201, 206-212, 224-248, 253-260, 287-295, 314-331, 338-344, 365-376, 396-405, 413-422, 424-430, 432-449, 478-485, 487-494, 503-517, 522-536, 544-560, 564-578, 585-590, 597-613, 615-623, 629-636, 640-649, 662-671, 713-721 | F: 21, G: 26, H: 6, K: 4, N: 5 | 176-330 | 56, 206 |
| Spy1371 | putative NADP-dependent glyceraldehyde-3-phosphate dehydrogenase | 31-37, 41-52, 58-79, 82-105, 133-179, 184-193, 199-205, 209-226, 256-277, 281-295, 297-314, 322-328, 331-337, 359-367, 379-395, 403-409, 417-432, 442-447, 451-460, 466-472 | D: 14, H: 3 | 46-62 296-341 | 57, 207 |
| Spy1375 | putative ribonucleotide reductase alpha-c | 23-29, 56-63, 67-74, 96-108, 122-132, 139-146, 152-159, 167-178, 189-196, 214-231, 247-265, 274-293, 301-309, 326-332, 356-363, 378-395, 406-412, 436-442, 445-451, 465-479, 487-501, 528-555, 567-581, 583-599, 610-617, 622-629, 638-662, 681-686, 694-700, 711-716 | A: 2 | 667-684 | 58, 208 |
| Spy1389 | putative alanyl-tRNA synthetase | 20-51, 53-59, 109-115, 140-154, 185-191, 201-209, 212-218, 234-243, 253-263, 277-290, 303-313, 327-337, 342-349, 374-382, 394-410, 436-442, 464-477, 486-499, 521-530, 536-550, 560-566, 569-583, 652-672, 680-686, 698-704, 718-746, 758-770, 774-788, 802-827, 835-842, 861-869 | B: 2, P: 3 | 258-416 | 59, 209 |
| Spy1390 | putative protease maturation protein | 7-25, 39-45, 59-70, 92-108, 116-127, 161-168, 202-211, 217-227, 229-239, 254-262, 271-278, 291-300 | A: 3, B: 2, D: 3 | 278-295 | 60, 210 |
| Spy1422 | putative recombination protein | 4-20, 27-33, 45-51, 53-62, 66-74, 81-88, 98-111, 124-130, 136-144, 156-179, 183-191 | C: 2 | 183-195 | 61, 211 |
| Spy1436 | putative deoxyribonuclease | 12-24, 27-33, 43-49, 55-71, 77-85, 122-131, 168-177, 179-203, 209-214, 226-241 | K: 1 | 63-238 | 62, 212 |
| Spy1494 | hypothetical protein | 4-19, 37-50, 120-126, 131-137, 139-162, 177-195, 200-209, 211-218, 233-256, 260-268, 271-283, 288-308 | G: 3, I: 5, K: 6, M: 5, N: 10, O: 6, P: 4 | 1-141 | 63, 213 |
| Spy1523 | cell division protein | 11-17, 40-47, 57-63, 96-124, 141-162, 170-207, 223-235, 241-265, 271-277, 281-300, 312-318, 327-333, 373-379 | I: 2 | 231-368 | 64, 214 |
| Spy1536 | conserved hypothetical protein | 9-33, 41-48, 57-79, 97-103, 113-138, 146-157, 165-186, 195-201, 209-215, 223-229, 237-247, 277-286, 290-297, 328-342 | A: 19, C: 3 | 247-260 | 65, 215 |
| Spy1564 | conserved hypothetical protein | 7-15, 39-45, 58-64, 79-84, 97-127, 130-141, 163-176, 195-203, 216-225, 235-247, 254-264, 271-279 | C: 4 | 64-72 | 66, 216 |
| Spy1604 | conserved hypothetical protein | 4-12, 26-42, 46-65, 73-80, 82-94, 116-125, 135-146, 167-173, 183-190, 232-271, 274-282, 300-306, 320-343, 351-362, 373-383, 385-391, 402-409, 414-426, 434-455, 460-466, 473-481, 485-503, 519-525, 533-542, | B: 2, K: 2 | 222-362 756-896 | 67, 217 |

TABLE 1-continued

Immunogenic proteins identified by bacterial surface display.

| S. pyogenes antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| | | 554-565, 599-624, 645-651, 675-693, 717-725, 751-758, 767-785, 792-797, 801-809, 819-825, 831-836, 859-869, 890-897 | | | |
| Spy1607 | conserved hypothetical protein | 11-17, 22-28, 52-69, 73-83, 86-97, 123-148, 150-164, 166-177, 179-186, 188-199, 219-225, 229-243, 250-255 | D: 5 | 153-170 | 68, 218 |
| Spy1615 | putative late competence protein | 4-61, 71-80, 83-90, 92-128, 133-153, 167-182, 184-192, 198-212 | C: 4 | 56-73 | 69, 219 |
| Spy1666 | conserved hypothetical protein | 4-19, 26-37, 45-52, 58-66, 71-77, 84-92, 94-101, 107-118, 120-133, 156-168, 170-179, 208-216, 228-238, 253-273, 280-296, 303-317, 326-334 | D: 2 | 298-312 | 70, 220 |
| Spy1727 | conserved hypothetical protein | 7-13, 27-35, 38-56, 85-108, 113-121, 123-160, 163-169, 172-183, 188-200, 206-211, 219-238, 247-254 | B: 5 | 141-157 | 71, 221 |
| Spy1785 | putative ATP-dependent DNA helicase | 23-39, 45-73, 86-103, 107-115, 125-132, 137-146, 148-158, 160-168, 172-179, 185-192, 200-207, 210-224, 233-239, 246-255, 285-334, 338-352, 355-379, 383-389, 408-417, 423-429, 446-456, 460-473, 478-503, 522-540, 553-562, 568-577, 596-602, 620-636, 640-649, 655-663 | D: 3 | 433-440 572-593 | 72, 222 |
| Spy1798 | hypothetical protein | 4-42, 46-58, 64-76, 118-124, 130-137, 148-156, 164-169, 175-182, 187-194, 203-218, 220-227, 241-246, 254-259, 264-270, 275-289, 296-305, 309-314, 322-334, 342-354, 398-405, 419-426, 432-443, 462-475, 522-530, 552-567, 593-607, 618-634, 636-647, 653-658, 662-670, 681-695, 698-707, 709-720, 732-742, 767-792, 794-822, 828-842, 851-866, 881-890, 895-903, 928-934, 940-963, 978-986, 1003-1025, 1027-1043, 1058-1075, 1080-1087, 1095-1109, 1116-1122, 1133-1138, 1168-1174, 1179-1186, 1207-1214, 1248-1267 | A: 12, I: 12, K: 7, N: 17, O: 13, P: 8 | 17-319 417-563 | 73, 223 |
| Spy1801 | immunogenic secreted protein precursor homolog | 6-19, 23-33, 129-138, 140-150, 153-184, 190-198, 206-219, 235-245, 267-275, 284-289, 303-310, 322-328, 354-404, 407-413, 423-446, 453-462, 467-481, 491-500 | H: 2, I: 8, K: 6, N: 11 | 46-187 | 74, 224 |
| Spy1813 | hypothetical protein | 4-34, 39-57, 78-86, 106-116, 141-151, 156-162, 165-172, 213-237, 252-260, 262-268, 272-279, 296-307, 332-338, 397-403, 406-416, 431-446, 448-453, 464-470, 503-515, 519-525, 534-540, 551-563, 578-593, 646-668, 693-699, 703-719, 738-744, 748-759, 771-777, 807-813, 840-847, 870-876, 897-903, 910-925, 967-976, 979-992 | I: 16, K: 12, N: 6 | 21-244 381-499 818-959 | 75, 225 |
| Spy1821 | putative translation elongation factor EF-P | 19-29, 65-75, 90-109, 111-137, 155-165, 169-175 | C: 6 | 118-136 | 76, 226 |
| Spy1916 | putative phospho-beta-D-galactosidase | 15-20, 30-36, 55-63, 73-79, 90-117, 120-127, 136-149, 166-188, 195-203, 211-223, 242-255, 264-269, 281-287, 325-330, 334-341, 348-366, 395-408, 423-429, 436-444, 452-465 | C: 8 | 147-155 | 77, 227 |
| Spy1972 | Pullulanase | 11-18, 21-53, 77-83, 91-98, 109-119, 142-163, 173-181, 193-208, 216-227, 238-255, 261-268, 274-286, 290-297, 308-315, 326-332, 352-359, 377-395, 399-406, 418-426, 428-438, 442-448, 458-465, 473-482, 488-499, 514-524, 543-553, 564-600, 623-632, 647-654, 660-669, 672-678, 710-723, 739-749, 787-793, 820-828, 838-860, 889-895, 901-907, 924-939, 956-962, 969-976, 991-999, 1012-1018, 1024-1029, 1035-1072, 1078-1091, 1142-1161 | A: 6, I: 2, K: 5, N: 9 | 74-438 | 78, 228 |
| Spy1979 | streptokinase A precursor | 4-31, 41-52, 58-63, 65-73, 83-88, 102-117, 123-130, 150-172, 177-195, 207-217, 222-235, 247-253, 295-305, 315-328, 335-342, 359-365, 389-394, 404-413 | I: 6, M: 3, N: 10 | 156-420 | 79, 229 |
| Spy1983 | collagen-like surface protein (SclD) | 4-42, 56-69, 108-120, 120-125, 210-216, 225-231, 276-285, 304-310, 313-318, 322-343 | A: 81, B: 24, F: 19, G: 41, I: 2, K: 2 | 79-348 | 80, 230 |
| Spy1991 | anthranilate synthase component II | 12-21, 24-30, 42-50, 61-67, 69-85, 90-97, 110-143, 155-168 | D: 2 | 53-70 | 81, 231 |
| Spy2000 | surface lipoprotein | 4-26, 41-54, 71-78, 88-96, 116-127, 140-149, 151-158, 161-175, 190-196, 201-208, 220-226, 240-247, 266-281, 298-305, 308-318, 321-329, 344-353, 370-378, 384-405, 418-426, 429-442, 457-463, 494-505, 514-522 | B: 3, N: 2 | 183-341 | 82, 232 |
| Spy2006 | hypothetical protein | 4-27, 69-77, 79-101, 117-123, 126-142, 155-161, 171-186, 200-206, 213-231, 233-244, 258-263, 269-275, 315-331, 337-346, 349-372, 376-381, 401-410, 424-445, 447-455, 463-470, 478-484, 520-536, 546-555, 558-569, 580-597, 603-618, 628-638, 648-660, 668-683, 717-723, 765-771, 781-788, 792-806, 812-822 | A: 15, B: 9, C: 5, D: 3, F: 18, G: 25, H: 5, M: 10, N: 5 | 92-231 618-757 | 83, 233 |

TABLE 1-continued

Immunogenic proteins identified by bacterial surface display.

| S. pyogenes antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| Spy2009 | hypothetical protein | 11-47, 63-75, 108-117, 119-128, 133-143, 171-185, 190-196, 226-232, 257-264, 278-283, 297-309, 332-338, 341-346, 351-358, 362-372 | B: 2, I: 7, K: 7, P: 2 | 41-170 | 84, 234 |
| Spy2010 | C5A peptidase precursor | 6-26, 50-56, 83-89, 108-114, 123-131, 172-181, 194-200, 221-238, 241-259, 263-271, 284-292, 304-319, 321-335, 353-358, 384-391, 408-417, 424-430, 442-448, 459-466, 487-500, 514-528, 541-556, 572-578, 595-601, 605-613, 620-631, 634-648, 660-679, 686-693, 702-708, 716-725, 730-735, 749-755, 770-777, 805-811, 831-837, 843-851, 854-860, 863-869, 895-901, 904-914, 922-929, 933-938, 947-952, 956-963, 1000-1005, 1008-1014, 1021-1030, 1131-1137, 1154-1164, 1166-1174 | A: 47, B: 10, D: 3, F: 48, G: 20, H: 4, I: 6, K: 13, M: 5, N: 10, P: 6 | 20-487 757-1153 | 85, 235 |
| Spy2016 | inhibitor of complement (Sic) | 10-34, 67-78, 131-146, 160-175, 189-194, 201-214, 239-250, 265-271, 296-305 | A: 11, B: 38, C: 16, F: 56, G: 27, H: 13, K: 5, N: 2, O: 3, P: 14 | 26-74 91-100 105-303 | 86, 236 |
| Spy2018 | M1-Protein | 9-15, 19-32, 109-122, 143-150, 171-180, 186-191, 209-217, 223-229, 260-273, 302-315, 340-346, 353-359, 377-383, 389-406, 420-426, 460-480 | A: 316, B: 26, C: 107, D: 12, E: 49, F: 88, G: 118, H: 6, I: 7, K: 2, M: 48, N: 4 | 10-223 231-251 264-297 312-336 | 87, 237 |
| Spy2025 | immunogenic secreted protein precursor | 5-28, 76-81, 180-195, 203-209, 211-219, 227-234, 242-252, 271-282, 317-325, 350-356, 358-364, 394-400, 405-413, 417-424, 430-436, 443-449, 462-482, 488-498, 503-509, 525-537 | F: 7, G: 16, H: 7, K: 63, L: 2, N: 18, O: 42 | 22-344 | 88, 238 |
| Spy2039 | pyrogenic exotoxin B | 5-28, 42-54, 77-83, 86-93, 98-104, 120-127, 145-159, 166-176, 181-187, 189-197, 213-218, 230-237, 263-271, 285-291, 299-305, 326-346, 368-375, 390-395 | I: 15, K: 3, N: 12 | 1-151 | 89, 239 |
| Spy2043 | mitogenic factor MF1 (speF) | 6-34, 48-55, 58-64, 84-101, 121-127, 143-149, 153-159, 163-170, 173-181, 216-225, 227-240, 248-254, 275-290, 349-364, 375-410, 412-418, 432-438, 445-451, 465-475, 488-496, 505-515, 558-564, 571-579, 585-595, 604-613, 626-643, 652-659, 677-686, 688-696, 702-709, 731-747, 777-795, 820-828, 836-842, 845-856, 863-868, 874-882, 900-909, 926-943, 961-976, 980-986, 992-998, 1022-1034, 1044-1074, 1085-1096, 1101-1112, 1117-1123, 1130-1147, 1181-1187, 1204-1211, 1213-1223, 1226-1239, 1242-1249, 1265-1271, 1273-1293, 1300-1308, 1361-1367, 1378-1384, 1395-1406, 1420-1428, 1439-1446, 1454-1460, 1477-1487, 1509-1520, 1526-1536, 1557-1574, 1585-1596, 1605-1617, 1621-1627, 1631-1637, 1648-1654, 1675-1689, 1692-1698, 1700-1706, 1712-1719, 1743-1756 | K: 1 | 91-263 | 90, 240 |
| Spy2059 | penicillin-binding protein 2a | 4-16, 75-90, 101-136, 138-144, 158-164, 171-177, 191-201, 214-222, 231-241, 284-290, 297-305, 311-321, 330-339, 352-369, 378-385, 403-412, 414-422, 428-435, 457-473, 503-521, 546-554, 562-568, 571-582, 589-594, 600-608, 626-635, 652-669, 687-702, 706-712, 718-724, 748-760, 770-775 | D: 2, E: 2 | 261-272 | 91, 241 |
| Spy2110 | putative anaerobic ribonucleoside-triphosphate reductase | 4-19, 30-41, 46-57, 62-68, 75-92, 126-132, 149-156, 158-168, 171-184, 187-194, 210-216, 218-238, 245-253, 306-312, 323-329, 340-351, 365-373, 384-391, 399-405, 422-432, 454-465, 471-481, 502-519, 530-541, 550-562, 566-572, 576-582, 593-599, 620-634, 637-643, 645-651, 657-664, 688-701 | E: 7 | 541-551 | 92, 242 |
| Spy2127 | Hypothetical protein | 6-11, 17-25, 53-58, 80-86, 91-99, 101-113, 123-131, 162-169, 181-188, 199-231, 245-252 | I: 6, P: 2 | 84-254 | 93, 243 |
| Spy2191 | hypothetical protein | 13-30, 71-120, 125-137, 139-145, 184-199 | C: 20, E: 3, M: 5 | 61-78 | 94, 244 |
| Spy2211 | transmembrance protein | 9-30, 38-53, 63-70, 74-97, 103-150, 158-175, 183-217, 225-253, 260-268, 272-286, 290-341, 352-428, 434-450, 453-460, 469-478, 513-525, 527-534, 554-563, 586-600, 602-610, 624-640, 656-684, 707-729, 735-749, 757-763, 766-772, 779-788, 799-805, 807-815, 819-826, 831-855 | A: 3 | 568-580 | 95, 245 |
| ARF0450 | no homology | 11-21, 29-38 | A: 11 | 5-17 | 96, 246 |
| ARF0569 | no homology | none | A: 2 | 2-9 | 97, 247 |
| ARF0694 | no homology | 4-10, 16-28 | B: 7, D: 3, M: 3 | 7-18 26-34 | 98, 248 |
| ARF0700 | No homology | 10-16 | M: 11 | 1-15 | 99, 249 |
| ARF1007 | No homology | none | B: 2 | 4-11 | 100, 250 |
| ARF1145 | No homology | 4-40, 42-51 | C: 9 | 37-53 | 101, 251 |

TABLE 1-continued

Immunogenic proteins identified by bacterial surface display.

| S. pyogenes antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| ARF1208 | no homology | 4-21 | C: 1 | 22-29 | 102, 252 |
| ARF1262 | No homology | none | D: 2 | 2-11 | 103, 253 |
| ARF1294 | 39% with SA0131 (first 28 aa of 67 aa protein) | 9-17, 32-44 | D: 2 | 1-22 | 104, 254 |
| ARF1316 | no homology | 19-25, 27-32 | E: 19 | 15-34 | 105, 255 |
| ARF1352 | 38% with SA1142 (aa 265-295 of 358 protein) | 4-12, 15-22 | D: 4 | 11-33 | 106, 256 |
| ARF1481 | No homology | 10-17, 24-30, 39-46, 51-70 | C: 2 | 51-61 | 107, 257 |
| ARF1557 | No homology | none | C: 2 | 6-19 | 108, 258 |
| ARF1629 | 36% with SP0069 (aa 139-169 of 211 aa protein) | 6-11, 21-27, 31-54 | A: 4, B: 6 | 11-29 | 109, 259 |
| ARF1654 | no homology | 4-10, 13-45 | A: 2 | 11-35 | 110, 260 |
| ARF2027 | no homology | 4-14, 23-32 | D: 2 | 11-35 | 111, 261 |
| ARF2093 | putative elongation factor TS | 14-39, 45-51 | C: 3 | 15-29 | 112, 262 |
| ARF2207 | 38% with SF1006 (aa 7-37 of 67 aa protein) | 4-11, 14-28 | A: 117 | 4-17 | 113, 263 |
| CRF0038 | No homology | 4-16 | C: 6 | 2-16 | 114, 264 |
| CRF0122 | No homology | 4-10, 12-19, 39-50 | C: 2 | 6-22 | 115, 265 |
| CRF0406 | no homology | none | D: 5, E: 11 | 2-13 | 116, 266 |
| CRF0416 | No homology | 4-11, 22-65 | C: 42 | 3-19 | 117, 267 |
| CRF0507 | No homology | 17-23, 30-35, 39-46, 57-62 | B: 3, C: 4 | 30-49 | 118, 268 |
| CRF0549 | No homology | 4-19 | C: 6 | 14-22 | 119, 269 |
| CRF0569 | No homology | none | N: 35 | 2-9 | 120, 270 |
| CRF0628 | 34% (14 of 41) with conserved hypothetical protein of P. aeruginosa | 7-18, 30-43 | A: 3 | 4-12 | 121, 271 |
| CRF0727 | 40% (16 of 40) with transcriptional regulator of S. pneumoniae (70 aa, SP0584) | 4-30, 39-47 | N: 6 | 5-22 | 122, 272 |
| CRF0742 | 33% with SA0422 (aa 11-37 of 42 aa protein, listed as 280 aa protein) | 6-15 | D: 7, E: 12 | 14-29 | 123, 273 |
| CRF0784 | No homology | 4-34 | N: 9 | 23-35 | 124, 274 |
| CRF0854 | No homology | 4-36, 44-57, 65-72 | N: 14 | 14-27 | 125, 275 |
| CRF0875 | no homology | 4-18 | A: 4, D: 1 | 11-20 | 126, 276 |
| CRF0907 | Homology to lysosomal trafficking regulator LYST [Homo sapiens] | none | A: 39 | 5-19 | 127, 277 |
| CRF0979 | no homology | 18-36 | D: 21 | 6-20 | 128, 278 |
| CRF1068 | no homology | 4-10, 19-34, 41-84, 96-104 | C: 1, D: 3 | 50-63 | 129, 279 |
| CRF1152 | No homology | 4-9, 19-27 | C: 15 | 8-21 | 130, 280 |
| CRF1203 | No homology | 4-16, 18-28 | N: 3 | 22-30 | 131, 281 |
| CRF1225 | No homology | 4-15 | C: 8 | 21-35 | 132, 282 |
| CRF1236 | No homology | 4-17 | N: 3 | 3-13 | 133, 283 |
| CRF1362 | No homology | 4-12 | C: 6 | 4-18 | 134, 284 |
| CRF1524 | no homology | 4-24, 31-36 | D: 3 | 29-45 | 135, 285 |
| CRF1525 | No homology | 12-22, 34-49 | C: 2 | 21-32 | 136, 286 |
| CRF1527 | no homology | 4-17 | D: 4, E: 1 | 22-32 | 137, 287 |
| CRF1588 | No homology | 4-16, 25-42 | C: 2 | 7-28 | 138, 288 |
| CRF1649 | No homology | 4-10 | C: 3 | 7-20 | 139, 289 |
| CRF1749 | No homology | 4-11, 16-36, 39-54 | C: 15 | 28-44 | 140, 290 |
| CRF1903 | no homology | 5-20, 29-54 | A: 14 | 14-29 | 141, 291 |
| CRF1964 | no homology | 24-33 | A: 8 | 10-22 | 142, 292 |
| CRF2055 | no homology | 10-51, 54-61 | B: 1, F: 12, H: 14 | 43-64 | 143, 293 |
| CRF2091 | No homology | 7-13 | C: 2 | 2-17 | 144, 294 |
| CRF2096 | No homology | 11-20 | C: 4 | 6-20 | 145, 295 |
| CRF2104 | No homology | 4-30, 34-41 | C: 2 | 19-28 | 146, 296 |

TABLE 1-continued

Immunogenic proteins identified by bacterial surface display.

| S. pyogenes antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| CRF2116 | No homology | n.d. | | 11-21 | 147, 297 |
| CRF2153 | no homology | 4-16, 21-26 | F: 2 | 9-38 | 148, 298 |
| NRF0001 | ARF in Oligo ABC transporter (not annotated by TIGR), 33% with SA0643 (aa 107-162 of 469 aa protein) | 4-12, 15-27, 30-42, 66-72 | A: 7, B: 1 | 10-24 | 149, 299 |
| NRF0003 | no homology | 8-17 | A: 23 | 11-20 | 150, 300 |

TABLE 2

| Peptide | Peptide Sequence | SEQ ID | Location in Protein (aa) |
|---|---|---|---|
| SPA0450.1 | SRFLPTRRDYSSLWSASC | 246 | 2-19 |
| SPA0569.1 | SFIWEKRNPEGS | 247 | 1-12 |
| SPA0694.2 | KTSQTIPTKRQKMRRTMT | 248 | 21-38 |
| SPA1294.1 | MLKAKKTNSKLVTLSQPTKKF | 254 | 2-22 |
| SPA1316.1 | GRTRHDHVNCYSRNGICSP | 255 | 15-33 |
| SPA1352.1 | QPKHKEQPVLKMLKNYESKKQI | 256 | 11-32 |
| SPA1629.1 | RDANDCQRTGFSKCDFSW | 259 | 11-28 |
| SPA1654.1 | MIQINTPLSILFPNTLVQ | 260 | 10-27 |
| SPA2027.1 | PFLKWLRSAKNNSKDIRC | 261 | 9-26 |
| SPA2207.1 | VKDVWSTLKIWER | 263 | 4-16 |
| SPC0406.1 | QAPLDDHHNKPTYWSGYL | 266 | 1-18 |
| SPC0742.1 | KYKSHKERLTINTFKRQG | 273 | 12-29 |
| SPC0875.1 | WHYQLKLSQVQTMTFPPL | 276 | 6-23 |
| SPC0907.1 | PNLLDHFLPNNPHQNHKAKLD | 277 | 1-21 |
| SPC1068.1 | FGHIDLSNASINNNQVRS | 279 | 47-64 |
| SPC1524.1 | LLNRGANISSQKVIKEVR | 285 | 28-45 |
| SPC1527.1 | TLKRFTFDTINFFDDNFW | 287 | 18-35 |
| SPC1903.1 | KPLVKVPPNRTMAPPNPP | 291 | 14-31 |
| SPC1964.1 | HQIGQKWKKERPKPTWSK | 292 | 7-24 |
| SPN0001.1 | TQQLFRKPSLSNNLLKHL | 299 | 8-25 |
| SPN0003.1 | SGRQDSNLRHLGPKPSTLPS | 300 | 1-20 |
| SPO0012.1 | PVISTEKKLIFSKNAV | 151 | 18-33 |
| SPO0012.2 | AYKDSDLTLPA | 151 | 62-72 |
| SPO0019.1 | INALINSKSISDVV | 152 | 118-131 |
| SPO0031.1 | DPSGTYHFTTRLPVKGQTSIDSPDLA | 154 | 195-220 |
| SPO0031.2 | DSPDLAYYEAGQSVYYDKVVTAGGYT | 154 | 215-240 |
| SPO0031.4 | PIKEPAQSVVQNDNTKPSIKVGDTVT | 154 | 255-280 |
| SPO0103.1 | KPSLSQLKAD | 155 | 72-81 |
| SPO0112.1 | EALAKAGVKNGIP | 156 | 174-186 |
| SPO0115.1 | YIHSHQTLYAMDDFV | 157 | 317-331 |
| SPO0166.1 | LEMSNSGQALDIYQAVQTLNAENML | 158 | 35-59 |
| SPO0166.2 | NAENMLLNYYESLPFYLNRQSILANMTKALK | 158 | 54-84 |
| SPO0166.3 | MTKALKDAHIREAMAHYKLGEFAHYQ | 158 | 79-104 |
| SPO0167.1 | SNKQNTASTETTTTNEQPKPESSELT | 159 | 33-58 |
| SPO0167.2 | KEMPLESAEKEEKKSEDKKKS | 159 | 81-101 |
| SPO0167.3 | PKEGVKKADKFIVIE | 159 | 136-150 |
| SPO0167.4 | TYPAALQLANKGFT | 159 | 173-186 |
| SPO0167.5 | NLVNQWHDNYSGGNTLPARTQ | 159 | 231-251 |
| SPO0171.1 | TPHHQTVHASPVTLTETCDKNGTVCFG | 161 | 22-48 |
| SPO0183.1 | MVKTGNKSEIFKKTG | 162 | 24-39 |
| SPO0230.1 | MSLPKGYNTYVSDDD | 163 | 475-489 |
| SPO0269.1 | DRASGETKASNTHDDSLPK | 164 | 38-56 |
| SPO0269.2 | TLKQSDSLNLQVRQLNDTKGSL | 164 | 583-604 |
| SPO0287.1 | EVIAQAGSQIKFSAIDRLGPSVTTY | 165 | 202-223 |
| SPO0287.2 | PSVTTYISRRGRLEKDANIDWALAVM | 165 | 222-247 |
| SPO0287.3 | WALAVMNEGNVIADFDSDLIGQGSQA | 165 | 242-267 |
| SPO0287.4 | GQGSQADLKVVAASSGRQVQGIDTRV | 165 | 262-287 |
| SFO0287.5 | GIDTRVTNYGQRTVGHILQHGVILER | 165 | 282-307 |
| SPO0287.6 | GVILERGTLTFNGIGHILKDAKGADA | 165 | 302-327 |
| SPO0292.1 | YSVTAKHAIAVDLESGKVLYEKDA | 166 | 25-48 |
| SPO0295.1 | SQTLGTPMYKIAVK | 167 | 204-217 |
| SPO0348.1 | EGGTAEPTKPSLGKILIP | 168 | 259-276 |
| SPO0416.1 | PVNTDVHDWVKTKGAWDKG | 169 | 121-139 |
| SPO0416.2 | DGSHDIDW | 169 | 260-267 |

TABLE 2-continued

| Peptide | Peptide Sequence | SEQ ID | Location in Protein (aa) |
|---|---|---|---|
| SPO0416.4 | EDFDEDWENFEFDAEAEPKAIKKHKI | 169 | 215-240 |
| SPO0430.1 | GQHKRDPLETEAEDDSQGGRQEGRQ | 170 | 115-140 |
| SPO0437.1 | KPWHQRLSENIQDQWWNFKGLFQ | 172 | 182-204 |
| SPO0469.1 | DVPTTPFASA | 173 | 144-153 |
| SPO0469.2 | KTDISEAPTSANRPV | 173 | 205-219 |
| SPO0488.1 | INPKGRQATIT | 174 | 196-206 |
| SPO0488.2 | TPGIPGKFKR | 174 | 240-249 |
| SPO0488.3 | NIKVIDEKSTGRFEPF | 174 | 272-287 |
| SFO0488.4 | KGRQATITYGDGSTDIIPPAVLWKK | 174 | 199-223 |
| SPO0488.5 | AVLWKKGSVKEPTEADQSVG | 174 | 218-237 |
| SPO0515.1 | GDVYEGAMTGADAFFFPSREETEG | 175 | 226-249 |
| SFO0515.2 | GFIEALKKVFSGASNKVEAG | 175 | 287-306 |
| SPO0580.1 | IARRLQDPLAELVKIDPKSI | 176 | 430-449 |
| SPO0621.1 | LENPRTQIEMMQKDG | 177 | 361-375 |
| SFO0630.1 | NKPKQVDATTVQGGQQDDWI | 178 | 241-260 |
| SFO0702.1 | ALVRKDGTHTAFVHFSNATP | 181 | 483-502 |
| SFO0710.1 | NYLGIGQTDKDGNRISLW | 182 | 379-396 |
| SFO0720.1 | LGSQAGLKEIIAQNFPDKKVL | 184 | 31-51 |
| SFO0737.1 | DLAEAAAKTKALIIEDKTLTDDQRK | 186 | 1436-1460 |
| SFO0737.2 | TDDQRKEQLLGVDTEYAKGI | 186 | 1455-1474 |
| SFO0737.3 | EYAKGIENIDAAKDAAGVD | 186 | 1469-1487 |
| SFO0747.1 | VRDDSGKSIVVHIDH | 187 | 215-229 |
| SFO0747.2 | HLKPEKTNLQKDLSKLSIASYNIENFSA | 187 | 534-561 |
| SPO0872.1 | QAGDMVGASPANSALL | 192 | 90-105 |
| SPO0872.2 | KVFNKMKFEYGTLGNHEFDEGLDEF | 192 | 112-136 |
| SPO0895.1 | FEKAVRNPLAHLIKPFDEEE | 193 | 290-209 |
| SPO0972.1 | KGSRGSKKSKTTALNFIV | 194 | 33-50 |
| SPO0981.1 | DELQELKNDKTRNEL | 195 | 76-90 |
| SPO1008.1 | MLKYSVKDKNLSVFFEKDW | 196 | 70-88 |
| SPO1032.1 | TRIKTLVTQGNAFYNVYDNLKTYHD | 197 | 418-442 |
| SPO1032.2 | ASKKLNNTSALA | 197 | 574-585 |
| SPO1054.1 | EKGEQGPTGKQGERGETG | 198 | 87-104 |
| SPO1054.2 | VGPAGKDGQNGKDGLPGKDGKDGQN | 198 | 124-148 |
| SPO1054.3 | KDGKDGQNGKDG | 198 | 141-152 |
| SPO1063.1 | IKHAPNMT | 199 | 241-248 |
| SPO1162.1 | QSILKGDANSLSIAAA | 200 | 183-198 |
| SPO1206.1 | GLVGANGEGKSTFMSIVT | 201 | 40-57 |
| SPO1228.1 | GSFGDAAKGKTIAAAQ | 202 | 202-217 |
| SPO1245.1 | DEFGSSNLGKTVNVQGGGSGTGLSQ | 203 | 50-74 |
| SPO1245.2 | GTGLSQVQSGAVQIGNSDVFAEEKD | 203 | 69-93 |
| SPO1245.3 | FAEEKDGIDASKLVDHQVAVAGLAV | 203 | 88-112 |
| SPO1245.4 | VAGLAVIANPKVKVSNLSSQQ | 203 | 107-127 |
| SPO1357.1 | KKQAIEDKEATTAIEAASS | 205 | 74-92 |
| SPO1361.1 | PGLHFPTSDGFQFNGQGIVGVTKDSI | 206 | 207-232 |
| SPO1361.2 | VTKDSILVDHDGHLHPISFADLRQGG | 206 | 227-252 |
| SPO1361.3 | DLRQGGWAHVADQYDPAKKAEKPAET | 206 | 247-272 |
| SPO1371.1 | ASAKKALSDWRALS | 207 | 47-60 |
| SPO1371.2 | ADQLAAEIK | 207 | 297-305 |
| SPO1371.3 | SVGMPEDDADITPLIDTSAADFVEGL | 207 | 312-337 |
| SPO1375.1 | LYEWKTQSKQTTRDLSIL | 208 | 667-384 |
| SPO1390.1 | DKANVKIKDKAFANILA | 210 | 279-295 |
| SPO1422.1 | DIEYADEVTLLRAIENRTEL | 211 | 179-198 |
| SPO1494.1 | NHLSATGDKFDDCSTLVEKDVAPKD | 213 | 27-51 |
| SPO1494.2 | DVAPKDELEMLAWSSSQTTDDADRD | 213 | 46-70 |
| SPO1494.3 | DDADRDYEDFLDDDSFISQNETDKM | 213 | 65-89 |
| SPO1494.4 | NETDKMFENLTDDRLLNELDELDEE | 213 | 84-108 |
| SPO1494.5 | DEEDTIEPEQNVIMPSDDELFDLTDAVETR | 213 | 112-141 |
| SPO1536.1 | ITKEDLRKGRTIA | 215 | 248-260 |
| SPO1564.1 | IFVQANERIEDDFRSLEKRF | 216 | 59-78 |
| SPO1607.1 | AQKVSQKLFDKYQEKLD | 218 | 154-170 |
| SPO1615.1 | CRDCLKWENKGYNVNHR | 219 | 57-73 |
| SPO1666.1 | EDMKPKFELVSRKPILPS | 220 | 297-314 |
| SPO1727.1 | KRSLPEFKSEVATIVH | 221 | 142-157 |
| SPO1785.1 | ELPAGRKPIMTRWVKHEQLG | 222 | 428-447 |
| SPO1785.2 | VLVANPKTDSGKKRMTIMTET | 222 | 573-593 |
| SPO1798.1 | EKVLVKLGKDLDGDGKLSKTEL | 223 | 523-544 |
| SPO1798,2 | RLLVEEIGPYASQSAGKEYYKHIEK | 223 | 46-70 |
| SPO1798.3 | YKHIEKIIVDNDVYEKSLEGERTFD | 223 | 65-89 |
| SPO1798.4 | GERTFDINYQGIKINADLIKDGKHE | 223 | 84-108 |
| SPO1798.6 | TFIKKGDKVTFISAQKLGTTDHQDSLKKDV | 223 | 122-151 |
| SPO1801.1 | KPTDQPKPSPSKVDTAPASS | 224 | 123-142 |
| SPO1813.1 | DTKGDRYSSPVVPELQILG | 225 | 903-921 |
| SPO1821.1 | EVIGVTVPTTVELTVAET | 226 | 119-136 |
| SPO1916.1 | AEFCFKEFSEVNYWTTFNEI | 227 | 142-161 |
| SPO1972.1 | ANEIGFLILDKSKTGDAIKV | 228 | 258-277 |
| SPO1972.2 | GDAIKVQPKDYLFKELDNHTQVFVKDTDP | 228 | 272-300 |
| SPO1972.3 | VKDTDPKVYNNPYYIDQVSLKGAEQTTP | 228 | 295-322 |

TABLE 2-continued

| Peptide | Peptide Sequence | SEQ ID | Location in Protein (aa) |
|---|---|---|---|
| SPO1979.1 | DPFDRSHLKLFTIKYVDVNTNELLKSEQLLTAS | 229 | 311-342 |
| SPO1979.2 | YEINPKTGIKEKTNNTDLVSEKYYVLK | 229 | 278-304 |
| SPO1983.1 | ERGAQGPKGDRGEQGIQGKA | 230 | 131-150 |
| SPO1983.2 | PGEKGEKGDRGETGAQGPVGPQGE | 230 | 195-218 |
| SPO1991.1 | WPKEANQMPKLIQDFYQT | 231 | 53-70 |
| SPO2000.1 | NPIGSGPYMVKEYKAGEQAIFVRNP | 232 | 184-208 |
| SPO2000.3 | WVLLDENTALAALESGDVDMIYATP | 232 | 222-246 |
| SPO2000.4 | MIYATPELADKKVKGTRLLDIPSND | 232 | 241-265 |
| SPO2000.5 | DIPSNDVRGLSLPYVKKGVITDSPD | 232 | 260-284 |
| SPO2000.6 | ITDSPDGYPVGNDVTSDPAIRKALT | 232 | 279-303 |
| SPO2000.8 | NGYGKPAYSIIDKTPFWNPKTAIKD | 232 | 317-341 |
| SPO2006.1 | VLAKETFVWKDGSFSIPRA | 233 | 678-696 |
| SPO2010.1 | PAKTADTPATSKATIRDLNDPSQVKTL | 235 | 88-114 |
| SPO2010.2 | PTASGTKLSRFSSWGLTA | 235 | 464-481 |
| SPO2016.1 | KRDDWGGPGTVATDPYTPPY | 236 | 153-172 |
| SPO2016.2 | DPYTPPYGGALGTGYEKRD | 236 | 137-155, 166-184 |
| SPO2016.3 | PQWNGFDGLSFGPS | 236 | 215-228 |
| SPO2018.1 | TEVKANGDGNPREVI | 237 | 37-51 |
| SPO2018.2 | DLAANNPAIQNIRLRYENKDLKA | 237 | 53-75 |
| SPO2018.3 | EEKQISDASRQSLRRDLDA | 237 | 232-251 |
| SPO2018.4 | EKQISDASRQGLRRDLDAS | 237 | 318-336 |
| SPO2025.1 | AFDFNPNNAKK | 238 | 305-315 |
| SPO2025.3 | QNKDGRPTPSPDQQKDQTPDKTPEKS | 238 | 131-156 |
| SPO2059.1 | GNGVWGVEDASQKYFGTT | 241 | 258-275 |
| SPO2127.1 | ARAVAEMIDYTKTSQGYYDVQAMLRKVDEDE | 243 | 107-137 |

TABLE 3

Gene distribution in *S. pyogenes* strains.

| ORF | Common name | Gene distribution (present of 50) | Amino acid substitutions (in strain M89) | Homology (SP/EC) | Seq. ID (DNA, Prot.) |
|---|---|---|---|---|---|
| Spy0012 | Hypothetical protein | 50 | 3/302 | SP0010 - 40%/None | 1, 151 |
| Spy0019 | putative secreted protein (cell division and antibiotic tolerance) | 50 | 0/300 | SP2216 - 44-49%/None | 2, 152 |
| Spy0025 | putative phosphoribosylformylglycina midine synthase II | 38 | 0/303 | SP0045 - 85%/24% | 3, 153 |
| Spy0031 | putative choline binding protein | 50 | 0/297 | SP2201 - 42% (cbpD)/None | 4, 154 |
| Spy0103 | putative competence protein | 50 | 0/81 | SP2051 - 41%/None | 5, 155 |
| Spy0112 | putative pyrroline carboxylate reductase | 50 | 3/235 | SP0933 - 32%/34% | 6, 156 |
| Spy0115 | putative glutamylaminopeptidase | 50 | 6/306 | SP1865 - 76%/30% | 7, 157 |
| Spy0166 | hypothetical protein | 50 | n.d. | None/None | 8, 158 |
| Spy0167 | Streptolysin O | 50 | 7/300 | SP1923 - 40% (Pneumolysin)/None | 9, 159 |
| Spy0168 | hypothetical protein | 8 | 19/126 | None/None | 10, 160 |
| Spy0171 | hypothetical protein | 18 | 8/95 | None/None | 11, 161 |
| Spy0183 | putative glycine betaine/proline ABC transporter | 50 | 0/297 | SP0151 - 39%/48% | 12, 162 |
| Spy0230 | putative ABC transporter (ATP-binding protein) | 50 | 1/299 | SP2073 - 64%/32% | 13, 163 |
| Spy0269 | putative surface exclusion protein | 50 | 1/303 | None/None | 14, 164 |
| Spy0287 | conserved hypothetical protein | 50 | 1/307 | SP0868 - 71%/19% | 15, 165 |
| Spy0292 | penicillin-binding protein (D-alanyl-D-alanine car | 50 | 1/359 | SP0872 - 47%/27% | 16, 166 |
| Spy0295 | oligopeptidepermease | 50 | 2/269 | SP1889 - 69%/24% | 17, 167 |
| Spy0348 | putative aminodeoxychorismate lyase | 50 | 1/307 | SP1518 - 47%/25% | 18, 168 |
| Spy0416 | putative cell envelope serine proteinase | 50 | 4/314 | SP0641 - 22%/None | 19, 169 |
| Spy0430 | hypothetical protein | 13 | 0/165# | None/None | 20, 170 |
| Spy0433 | hypothetical protein | 21 (27/49)[1] | 2/174# | None/None | 21, 171 |
| Spy0437 | Hypothetical protein | 19 (34/49)[1] | 0/106# | None/None | 22, 172 |
| Spy0469 | putative 42 kDa protein | 50 | 6/313 | SP2063 - 44% (LysM protein)/None | 23, 173 |

TABLE 3-continued

Gene distribution in *S. pyogenes* strains.

| ORF | Common name | Gene distribution (present of 50) | Amino acid substitutions (in strain M89) | Homology (SP/EC) | Seq. ID (DNA, Prot.) |
|---|---|---|---|---|---|
| Spy0488 | hypothetical protein | 50 | 9/178 | None/None | 24, 174 |
| Spy0515 | Putative sugar transferase | 50 | n.d. | SP1075 - 26%/None | 25, 175 |
| Spy0580 | conserved hypothetical protein | 50 | 0/297 | SP0908 - 72%/43% | 26, 176 |
| Spy0621 | conserved hypothetical protein | 50 | n.d. | SP1290 - 72%/None | 27, 177 |
| Spy0630 | putative PTS dependent N-acetyl-galactosamine-IIC | 50 | n.d. | SP0324 - 79%/30% | 28, 178 |
| Spy0681 | hypothetical protein, phage associated | 27 | 2/303# | None/None | 29, 179 |
| Spy0683 | putative minor capsid protein, phage associated | 25 | 1/233 | None/None | 30, 180 |
| Spy0702 | Hypothetical protein | 22 | n.d. | None/None | 31, 181 |
| Spy0710 | conserved hypothetical protein, phage associated | 32 | 51/286# | None/36% in 122 of 313aa | 32, 182 |
| Spy0711 | pyrogenic exotoxin C precursor, phage associated (speC) | 17 | 1/225 | None/None | 33, 183 |
| Spy0720 | conserved hypothetical protein | 50 | 2/270 | SP1298 - 60% (DHH 1 protein)/None | 34, 184 |
| Spy0727 | Putative DNA gyrase, subunit B | n.d. | n.d. | SP0806 - 80%/46% | 35, 185 |
| Spy0737 | putative extracellular matrix binding protein | 29 (48/49)[1] | 0/466# | None/27% in 340of 421aa | 36, 186 |
| Spy0747 | extracellular nuclease | 50 | 0/179 | None/None | 37, 187 |
| Spy0777 | putative ATP-dependent exonuclease, subunit A | 50 | 2/306 | SP1152 - 48%/22% | 38, 188 |
| Spy0789 | putative ABC-transporter (permease protein | 50 | 1/231 | None/None | 39, 189 |
| Spy0839 | putative glycerophosphodiester phosphodieste | 50 | 1/301 | SP0994 - 24%/31% in 121 of 358aa | 40, 190 |
| Spy0843 | cell surface protein | 50 | 3/312 | None/None | 41, 191 |
| Spy0872 | putative secreted 5'-nucleotidase | 50 | 2/309 | None/27% in 274 of 647aa | 42, 192 |
| Spy0895 | histidine protein kinase | 50 | 0/244 | None/None | 43, 193 |
| Spy0972 | putative terminase, large subunit - phage | 28 | 1/314# | None/None | 44, 194 |
| Spy0981 | hypothetical protein - phage associated | 23 | n.d. | None/None | 45, 195 |
| Spy1008 | streptococcal exotoxin H precursor (speH) | 15 (14/49)[1] | 1/223# | None/None | 46, 196 |
| Spy1032 | extracellular hyaluronate lyase | 50 (175 of 175, Hynes 2000) | 3/311 | SP0314 - 51%/None | 47, 197 |
| Spy1054 | putative collagen-like protein (SclC) | 26, (45/49)[1] (50 of 50, but varying number of repeats; Lukomski, 2001) | n.d. | None/None | 48, 198 |
| Spy1063 | putative periplasmic-iron-binding protein | 49/50 (49/49)[1] | 2/292# | SP0243 - 52%, iron ABC transporter/26% in 161 of 348aa | 49, 199 |
| Spy1162 | putative ribonuclease HII | 50 | 3/240 | SP1156 - 67%/46% | 50, 200 |
| Spy1206 | putative ABC transporter | 50 | 1/302 | SP0770 - 81%/30% | 51, 201 |
| Spy1228 | Putative lipoprotein | 49 | n.d. | SP0845 - 57%/None | 52, 202 |
| Spy1245 | Putative ABC transporter | 50 | n.d. | SP1400 - 64%/None | 53, 203 |
| Spy1315 | hypothetical protein | 50 | 4/305 | SP1241 - 64%/32% | 54, 204 |
| Spy1357 | protein GRAB (protein G-related alpha 2M-binding protein) | 49; 11 of 12 strains (Rasmussen, 1999) | 9/226; insertion of 28 aa | None/None | 55, 205 |
| Spy1361 | putative internalin A precursor | 50 | 7/295 | SP1004 - 26% in 283 of 1039/None | 56, 206 |
| Spy1371 | putative NADP-dependent glyceraldehyde-3-phosphate dehydrogenase | 50 | 2/308 | SP1119 - 71%/34% | 57, 207 |
| Spy1375 | putative ribonucleotide reductase alpha-c | 50 | 4/304 | SP1179 - 85%/49% | 58, 208 |
| Spy1389 | putative alanyl-tRNA synthetase | 50 | 0/309 | SP1383 - 74%/40% | 59, 209 |
| Spy1390 | putative protease maturation protein | 50 | 0/232 | SP0981 - 42%/None | 60, 210 |
| Spy1422 | putative recombination protein | n.d. | n.d. | SP1672 - 88%/64% | 61, 211 |

TABLE 3-continued

Gene distribution in *S. pyogenes* strains.

| ORF | Common name | Gene distribution (present of 50) | Amino acid substitutions (in strain M89) | Homology (SP/EC) | Seq. ID (DNA, Prot.) |
|---|---|---|---|---|---|
| Spy1436 | putative deoxyribonuclease | 25 | 0/243# | SP1964 - 29% in 181 of 274aa/None | 62, 212 |
| Spy1494 | hypothetical protein | 50 | 13/282 | None/None | 63, 213 |
| Spy1523 | cell division protein | 49 | 2/329 | SP0690 - 27%/None | 64, 214 |
| Spy1536 | conserved hypothetical protein | 50 | 9/280 | SP1967 - 57%/None | 65, 215 |
| Spy1564 | conserved hypothetical protein | 39 | n.d. | None/None | 66, 216 |
| Spy1604 | conserved hypothetical protein | 50 | 1/233 | SP2143 - 47%/28% | 67, 217 |
| Spy1607 | conserved hypothetical protein | 50 | 0/241 | SP1902 - 55%/None | 68, 218 |
| Spy1615 | putative late competence protein | 50 | 2/204 | SP2207 - 41%/None | 69, 219 |
| Spy1666 | conserved hypothetical protein | 50 | 2/305 | SP0334 (yllC) - 78%/40% | 70, 220 |
| Spy1727 | conserved hypothetical protein | 50 | 0/237 | SP0549 - 53%/None | 71, 221 |
| Spy1785 | putative ATP-dependent DNA helicase | 50 | 1/306 | SP1697 - 71%/37% | 72, 222 |
| Spy1798 | hypothetical protein | 50 | 2/128 | None/None | 73, 223 |
| Spy1801 | immunogenic secreted protein precursor homolog | 50 | 6/313; insertion of 6 aa | SP2216 - 33% in 119 of 392aa/None | 74, 224 |
| Spy1813 | hypothetical protein | 46 | 47/433; insertion of 9, deletion of 1 aa | None/None | 75, 225 |
| Spy1821 | putative translation elongation factor EF-P | n.d. | n.d. | SP0435 - 94%/45% | 76, 226 |
| Spy1916 | putative phospho-beta-D-galactosidase | n.d. | n.d. | SP1184 - 91%/83% | 77, 227 |
| Spy1972 | Pullulanase | 50 | 1/233 | SP0268 - 53%, SP1118 - 29%/25% in 352 of 657aa | 78, 228 |
| Spy1979 | streptokinase A precursor | 50 | 20.1% identical of 309# | None/None | 79, 229 |
| Spy1983 | collagen-like surface protein (SclD) | 50, (50 of 50, but size variation according to Lukomski, 2000 | n.d. | None/None | 80, 230 |
| Spy1991 | anthranilate synthase component II | 50 | 1/170 | SP1816 - 58%/47% | 81, 231 |
| Spy2000 | surface lipoprotein | 50 | 0/307 | None/27% in 389 of 524aa | 82, 232 |
| Spy2006 | hypothetical protein | 50 | 0/234 | SP1003 - 36%, SP1174 - 37%, SP1004 - 33%, SP1175 - 48%/None | 83, 233 |
| Spy2009 | hypothetical protein | 39 (38/49)[1] | 58/344; insertion of 36, deletion of 4 aa | None/None | 84, 234 |
| Spy2010 | C5A peptidase precursor | n.d. | n.d. | SP0641 - 23% in 783 of 2140aa/None | 85, 235 |
| Spy2016 | inhibitor of complement (Sic) | 47; mainly in M1 strains (Reid 2001) | 11/269# | None/None | 86, 236 |
| Spy2018 | M1-Protein | n.d. | n.d. | None/None | 87, 237 |
| Spy2025 | immunogenic secreted protein precursor | 50 | 3/296 | SP2216 - 31% in 138 of 392aa/None | 88, 238 |
| Spy2039 | pyrogenic exotoxin B | n.d. | n.d. | None/None | 89, 239 |
| Spy2043 | mitogenic factor MF1 (speF) | 50 | 0/247 | None/None | 90, 240 |
| Spy2059 | penicillin-binding protein 2a | 50 | 0/293 | SP2010 - 55% (pbp2A)/30% in 539 of 844aa | 91, 241 |
| Spy2110 | putative anaerobic ribonucleoside-triphosphate reductase | 50 | 0/311 | SP0202 - 80% (nrdD)/50% | 92, 242 |
| Spy2127 | Hypothetical protein | 1 | n.d. | None/None | 93, 243 |
| Spy2191 | hypothetical protein | 50 | 1/175 | None/None | 94, 244 |
| Spy2211 | transmembrane protein | 50 | 2/281 | SP2231 - 43%/None | 95, 245 |
| ARF0450 | hypothetical protein | 50 | 5/191 | None/None | 96, 246 |
| ARF0569 | hypothetical protein | n.d. | n.d. | None/None | 97, 247 |
| ARF0694 | hypothetical protein | 23 | 1/122# | None/None | 98, 248 |
| ARF0700 | hypothetical protein | n.d. | n.d. | None/None | 99, 249 |
| ARF1007 | hypothetical protein | n.d. | n.d. | None/None | 100, 250 |
| ARF1145 | hypothetical protein | n.d. | n.d. | None/None | 101, 251 |
| ARF1208 | hypothetical protein | n.d. | n.d. | None/None | 102, 252 |
| ARF1262 | hypothetical protein | n.d. | n.d. | None/None | 103, 253 |
| ARF1294 | hypothetical protein | 50 | 1/186 | 39% with SA0131 (first 28 aa of 67 aa protein) | 104, 254 |

TABLE 3-continued

Gene distribution in S. pyogenes strains.

| ORF | Common name | Gene distribution (present of 50) | Amino acid substitutions (in strain M89) | Homology (SP/EC) | Seq. ID (DNA, Prot.) |
|---|---|---|---|---|---|
| ARF1316 | hypothetical protein | n.d. | n.d. | None/None | 105, 255 |
| ARF1352 | hypothetical protein | n.d. | n.d. | 38% with SA1142 (aa 265-295 of 358 protein) | 106, 256 |
| ARF1481 | hypothetical protein | n.d. | n.d. | None/None | 107, 257 |
| ARF1557 | hypothetical protein | n.d. | n.d. | None/None | 108, 258 |
| ARF1629 | hypothetical protein | n.d. | n.d. | 36% with SP0069 (aa 139-169 of 211 aa protein) | 109, 259 |
| ARF1654 | hypothetical protein | n.d. | n.d. | None/None | 110, 260 |
| ARF2027 | hypothetical protein | n.d. | n.d. | None/None | 111, 261 |
| ARF2093 | hypothetical protein | n.d. | n.d. | None/None | 112, 262 |
| ARF2207 | hypothetical protein | 50 | n.d. | 38% with SP1006 (aa 7-37 of 67 aa protein) | 113, 263 |
| CRF0038 | hypothetical protein | n.d. | n.d. | None/None | 114, 264 |
| CRF0122 | hypothetical protein | n.d. | n.d. | None/None | 115, 265 |
| CRF0406 | hypothetical protein | n.d. | n.d. | None/None | 116, 266 |
| CRF0416 | hypothetical protein | n.d. | n.d. | None/None | 117, 267 |
| CRF0507 | hypothetical protein | n.d. | n.d. | None/None | 118, 268 |
| CRF0549 | hypothetical protein | n.d. | n.d. | None/None | 119, 269 |
| CRF0569 | hypothetical protein | n.d. | n.d. | None/None | 120, 270 |
| CRF0628 | hypothetical protein | n.d. | n.d. | None/None | 121, 271 |
| CRF0727 | hypothetical protein | n.d. | n.d. | 40% with SP0584 (aa21-60 of 70aa protein) | 122, 272 |
| CRF0742 | hypothetical protein | n.d. | n.d. | 33% with SA0422 (aa 11-37 of 42 aa protein, listed as 280 aa protein) | 123, 273 |
| CRF0784 | hypothetical protein | n.d. | n.d. | None/None | 124, 274 |
| CRF0854 | hypothetical protein | n.d. | n.d. | None/None | 125, 275 |
| CRF0875 | hypothetical protein | n.d. | n.d. | None/None | 126, 276 |
| CRF0907 | hypothetical protein | n.d. | n.d. | Homology to lysosomal trafficking regulator LYST [Homo sapiens] | 127, 277 |
| CRF0979 | hypothetical protein | n.d. | n.d. | None/None | 128, 278 |
| CRF1068 | hypothetical protein | 50 | 0/148 | None/None | 129, 279 |
| CRF1152 | hypothetical protein | n.d. | n.d. | None/None | 130, 280 |
| CRF1203 | hypothetical protein | n.d. | n.d. | None/None | 131, 281 |
| CRF1225 | hypothetical protein | n.d. | n.d. | None/None | 132, 282 |
| CRF1236 | hypothetical protein | n.d. | n.d. | None/None | 133, 283 |
| CRF1362 | hypothetical protein | n.d. | n.d. | None/None | 134, 284 |
| CRF1524 | hypothetical protein | n.d. | n.d. | None/None | 135, 285 |
| CRF1525 | hypothetical protein | n.d. | n.d. | None/None | 136, 286 |
| CRP1527 | hypothetical protein | n.d. | n.d. | None/None | 137, 287 |
| CRF1588 | hypothetical protein | n.d. | n.d. | None/None | 138, 288 |
| CRF1649 | hypothetical protein | n.d. | n.d. | None/None | 139, 289 |
| CRF1749 | hypothetical protein | n.d. | n.d. | None/None | 140, 290 |
| CRF1903 | hypothetical protein | 50 | 0/140 | None/None | 141, 291 |
| CRF1964 | hypothetical protein | n.d. | n.d. | None/None | 142, 292 |
| CRF2055 | hypothetical protein | n.d. | n.d. | None/None | 143, 293 |
| CRF2091 | hypothetical protein | n.d. | n.d. | None/None | 144, 294 |
| CRF2096 | hypothetical protein | n.d. | n.d. | None/None | 145, 295 |
| CRF2104 | hypothetical protein | n.d. | n.d. | None/None | 146, 296 |
| CRF2116 | hypothetical protein | n.d. | n.d. | None/None | 147, 297 |
| CRF2153 | hypothetical protein | n.d. | n.d. | None/None | 148, 298 |
| NRF0001 | hypothetical protein | 50 | 0/130 | ARF in Oligo ABC transporter (not annotated by TIGR), 33% with SA0643 (aa 107-162 of 469 aa protein) | 149, 299 |
| NRF0003 | hypothetical protein | n.d. | n.d. | None/None | 150, 300 |

TABLE 4

Recombinant proteins used for immunisation experiments in NMRI mice.

| ORF | Length (amino acids) | Amino acids[A] From | to | Solubility | Protection[B] | Total size of the fragment cloned (Kbp) |
|---|---|---|---|---|---|---|
| Spy0031 | 374 | 39 | 374 | Insoluble | 20% (10%, 40%) | 1.008 |
| Spy0103 | 108 | 2 | 108 | | 50% (10%, 80%) | 0.321 |
| Spy0269 | 873 | 36 | 873 | Soluble | 40% (40%, 70%)[C] | 2.511 |

TABLE 4-continued

Recombinant proteins used for immunisation experiments in NMRI mice.

| ORF | Length (amino acids) | Amino acids[A] From | to | Solubility | Protection[B] | Total size of the fragment cloned (Kbp) |
|---|---|---|---|---|---|---|
| Spy0292 | 410 | 22 | 410 | Insoluble | 70% (10%, 80%) | 1.164 |
| Spy0416A | 1647 | 33 | 867 | Soluble | 50% (10%, 40%) | 2.502 |
| Spy0416B | 1647 | 736 | 1617 | Solubilized | 0% (0%, 40%) | 2.646 |
| Spy0720 | 313 | 2 | 313 | Insoluble | 60% (10%, 80%) | 0.939 |
| Spy0872 | 670 | 27 | 640 | Solubilized | 60% (10%, 80%) | 1.839 |
| Spy1245 | 288 | 49 | 288 | Soluble | 20% (10%, 40%) | 0.717 |
| Spy1357 | 217 | 33 | 186 | Soluble | 40% (30%, 90%) | 0.459 |
| Spy1361 | 792 | 22 | 792 | Soluble | 60% (30%, 90%) | 2.31 |
| Spy1390 | 351 | 21 | 351 | | 60% (10%, 80%) | 0.99 |
| Spy1536 | 345 | 31 | 345 | | 20% (0%, 40%) | 0.942 |
| Spy1607 | 258 | 2 | 258 | | 40% (10%, 40%) | 0.771 |
| Spy1666 | 337 | 22 | 337 | Soluble | 50% (30%, 90%) | 0.945 |
| Spy1972 | 1165 | 45 | 500 | | 40% (30%, 90%) | 1.365 |
| Spy2000 | 542 | 24 | 542 | Soluble | 20% (30%, 90%) | 1.554 |
| Spy2025 | 541 | 27 | 541 | | 40% (40%, 70%) | 1.542 |
| Spy2191 | 204 | 36 | 204 | | 50% (10%, 80%) | 0.504 |

TABLE 5

Variability of antigens in strains of S. pyogenes.

| Antigen name | Seq ID | Residue in Antigen[A] | Residue number | Amino acid variations[B] |
|---|---|---|---|---|
| Spy0031 | 154 | G | 126 | D |
| | | A | 192 | S |
| | | V | 233 | I |
| | | D | 328 | N |
| | | I | 338 | T |
| Spy0103 | 155 | none | | |
| Spy0269 | 164 | H | 97 | N |
| | | A | 150 | V |
| | | A | 168 | V |
| | | H | 482 | R |
| | | N | 485 | K |
| | | Q | 577 | E |
| | | A | 610 | V |
| | | L | 636 | M |
| | | E | 640 | K |
| | | P | 752 | S |
| | | I | 764 | V |
| | | D | 765 | E |
| | | K | 873 | R |
| Spy0292 | 166 | A | 214 | D |
| | | Y | 309 | S |
| | | T | 317 | N |
| | | V | 318 | C |
| | | K | 319 | Q |
| Spy0416 | 169 | V | 1 | M |
| | | F | 25 | M |
| | | L | 26 | M |
| | | V | 27 | M |
| | | S | 38 | T |
| | | M | 40 | T |
| | | A | 49 | T |
| | | S | 68 | P |
| | | L | 76 | P |
| | | S | 85 | P |
| | | D | 87 | G |
| | | S | 104 | P |
| | | S | 110 | P |
| | | D | 151[C] | A, S, T, G |
| | | S | 164 | P |
| | | E | 215 | G |
| | | H | 279[C] | A, S, T, G |
| | | T | 395 | I |
| | | D | 452 | N |
| | | N | 478 | K |
| | | G | 484 | D |
| | | A | 547 | V |
| | | S | 617[C] | A, S, T, G |
| | | D | 723 | A |
| | | H | 749 | R |
| | | R | 770 | K |
| | | P | 787 | S |
| | | D | 804 | A |
| | | T | 874 | M |
| | | N | 913 | S |
| | | H | 991 | Y |
| | | N | 1080 | S |
| | | V | 1238 | A |
| | | D | 1313 | G |
| | | V | 1349 | M |
| | | A | 1393 | V |
| | | N | 1479 | K |
| | | I | 1487 | M |
| | | D | 1516 | G |
| | | N | 1555 | D |
| | | T | 1560 | A |
| | | S | 1599 | F |
| | | S | 1605 | T |
| | | T | 1617 | A |
| Spy0720 | 184 | A | 61 | T |
| | | I | 63 | M |
| | | K | 99 | Q |
| | | K | 109 | Q |
| | | N | 295 | S |
| Spy0872 | 192 | K | 178 | N |
| | | P | 181 | S |
| | | V | 253 | I |
| | | A | 393 | V |
| | | T | 600 | I |
| | | V | 605 | I |
| Spy1063 | 199 | N | 168 | S |
| | | A | 169 | S |
| | | D | 170 | E |
| | | A | 173 | E |
| | | M | 175 | V |
| | | V | 180 | L |
| | | N | 181 | S |
| | | E | 192 | D |
| | | Q | 195 | E |

TABLE 5-continued

Variability of antigens in strains of S. pyogenes.

| Antigen name | Seq ID | Residue in Antigen[A] | Residue number | Amino acid variations[B] |
|---|---|---|---|---|
| | | K | 228 | D |
| | | H | 243 | K |
| | | P | 245 | K |
| | | N | 246 | A |
| | | T | 248 | K |
| | | L | 252 | Q |
| | | M | 257 | I |
| | | R | 260 | S |
| | | Q | 277 | R |
| | | D | 284 | E |
| | | A | 287 | P |
| | | E | 289 | D |
| | | T | 290 | E |
| | | A | 292 | I |
| | | A | 299 | G |
| | | K | 303 | R |
| | | V | 309 | L |
| | | A | 310 | N |
| | | Q | 314 | R |
| | | R | 316 | H |
| | | Q | 317 | E |
| | | R | 318 | A |
| | | K | 321 | R |
| | | A | 322 | G |
| Spy1245 | 203 | L | 72 | M |
| | | A | 97 | P |
| | | Q | 213 | K |
| Spy1357 | 205 | C | 9 | Y |
| | | G | 48 | R |
| | | I | 87 | L |
| | | S | 91 | A |
| | | T | 102 | A |
| | | L | 105 | V |
| | | A | 111 | S |
| | | N | 117 | T |
| | | E | 139 | S, A |
| | | Q | 142 | K |
| | | S | 143 | A |
| | | N | 145 | T |
| | | W | 151 | L |
| | | A | 155 | D |
| | | T | 156 | N |
| | | P | 157 | A |
| | | I | 158 | T, A |
| | | A | 159 | S |
| | | L | 160 | D |
| | | D | 161 | A |
| | | V | 162 | L |
| | | K | 163 | E |
| | | K | 164 | A |
| | | T | 165 | L |
| | | K | 166 | A |
| | | T | 168 | Q |
| | | K | 169 | T |
| | | P | 170 | S, D |
| | | V | 171 | A |
| | | K | 173 | Q |
| | | K | 174 | S |
| | | G | 187 | S |
| | | A | 197 | T |
| | | V | 207 | A |
| Spy1361 | 206 | R | 129 | Q |
| | | P | 141 | S |
| | | L | 197 | P |
| | | A | 201 | V |
| | | D | 230 | A |
| | | S | 231 | N |
| | | D | 235 | N |
| | | P | 262 | L |
| | | T | 272 | N |
| | | Q | 274 | H |
| | | T | 302 | A |
| | | T | 308 | I |
| | | A | 346 | V |
| | | V | 354 | F |
| | | P | 389 | L |
| | | M | 391 | K |
| | | I | 427 | L |
| | | P | 431 | L |
| | | P | 503 | S |
| | | D | 645 | N |
| | | S | 696 | P |
| | | K | 738 | N |
| | | T | 757 | A |
| Spy1390 | 210 | N | 3 | Q |
| | | S | 4 | M |
| | | A | 9 | T |
| | | S | 10 | G |
| | | S | 16 | T |
| | | M | 18 | V |
| | | A | 19 | T |
| | | A | 21 | S |
| | | T | 26 | S |
| | | N | 27 | H |
| | | D | 28 | N |
| | | V | 32 | L |
| | | I | 33 | V |
| | | S | 41 | T |
| | | V | 54 | L |
| | | S | 55 | A |
| | | N | 61 | S |
| | | A | 70 | T |
| | | G | 73 | A |
| | | D | 74 | N |
| | | K | 78 | D |
| | | H | 86 | K |
| | | K | 87 | Q |
| | | E | 90 | D |
| | | A | 94 | T |
| | | S | 97 | K |
| | | A | 98 | T |
| | | A | 99 | V |
| | | S | 104 | G |
| | | F | 110 | Y |
| | | R | 112 | K |
| | | S | 116 | L |
| | | S | 117 | T |
| | | A | 127 | Q |
| | | K | 130 | N |
| | | L | 132 | I |
| | | T | 133 | S |
| | | T | 134 | K |
| | | Q | 135 | K |
| | | E | 136 | D |
| | | K | 138 | R |
| | | K | 139 | Q |
| | | E | 142 | D |
| | | S | 143 | A |
| | | A | 149 | T |
| | | V | 150 | A |
| | | M | 152 | I |
| | | I | 153 | M |
| | | T | 154 | Q |
| | | L | 155 | F |
| | | D | 156 | E |
| | | N | 157 | K |
| | | E | 158 | D |
| | | T | 160 | D |
| | | S | 163 | A |
| | | V | 164 | A |
| | | T | 176 | A |
| | | T | 184 | I |
| | | T | 185 | A |
| | | P | 186 | A |
| | | E | 187 | D |
| | | V | 190 | T |
| | | K | 193 | T |
| | | A | 198 | E |

TABLE 5-continued

Variability of antigens in strains of S. pyogenes.

| Antigen name | Seq ID | Residue in Antigen[A] | Residue number | Amino acid variations[B] |
|---|---|---|---|---|
| | | T | 199 | I |
| | | N | 200 | T |
| | | V | 201 | L |
| | | T | 203 | A |
| | | D | 204 | E |
| | | K | 207 | R |
| | | S | 211 | G |
| | | N | 213 | K |
| | | G | 216 | N |
| | | I | 217 | R |
| | | D | 219 | E |
| | | V | 220 | I |
| | | S | 222 | T |
| | | V | 223 | A |
| | | T | 227 | A |
| | | S | 228 | T |
| | | Y | 229 | S |
| | | Q | 230 | K |
| | | K | 231 | R |
| | | K | 232 | T |
| | | F | 233 | Y |
| | | Y | 234 | H |
| | | V | 236 | I |
| | | E | 243 | T |
| | | S | 246 | A |
| | | Q | 249 | K |
| | | E | 250 | A |
| | | E | 252 | A |
| | | A | 257 | D |
| | | I | 260 | V |
| | | A | 261 | T |
| | | E | 262 | G |
| | | S | 264 | L |
| | | M | 267 | P |
| | | N | 268 | D |
| | | N | 276 | K |
| | | Y | 297 | F |
| | | N | 299 | K |
| | | L | 300 | P |
| | | G | 301 | N |
| | | T | 304 | Q |
| | | K | 305 | P |
| | | A | 307 | Q |
| | | S | 308 | K |
| Spy1536 | 215 | none | | |
| Spy1607 | 218 | E | 21 | D |
| | | A | 91 | P |
| | | H | 194 | R |
| | | D | 204 | G, N |
| Spy1666 | 220 | K | 90 | Q |
| | | K | 302 | T |
| | | *S. peumoniae* TIGR4 | | |
| | | V | 37 | I |
| | | I | 42 | V |
| | | S | 56 | A |
| | | A | 60 | E |
| | | G | 67 | S |
| | | E | 69 | K |
| | | C | 74 | A |
| | | K | 80 | N |
| | | V | 87 | K |
| | | T | 88 | R |
| | | K | 90 | A, Q |
| | | S | 91 | P |
| | | D | 94 | E |
| | | Q | 97 | M |
| | | K | 109 | Q |
| | | R | 111 | C |
| | | T | 113 | R |
| | | A | 114 | E |
| | | L | 115 | A |
| | | D | 118 | Q |
| | | L | 124 | C |
| | | E | 136 | Q |
| | | Q | 145 | K |
| | | D | 154 | N |
| | | R | 155 | Q |
| | | Q | 156 | D |
| | | S | 157 | A |
| | | L | 158 | S |
| | | T | 167 | N |
| | | P | 169 | D |
| | | F | 170 | Y |
| | | N | 171 | H |
| | | K | 175 | R |
| | | A | 198 | E |
| | | I | 199 | V |
| | | L | 211 | I |
| | | A | 214 | L |
| | | A | 215 | V |
| | | D | 252 | Q |
| | | E | 255 | D |
| | | L | 256 | M |
| | | D | 287 | E |
| | | L | 294 | F |
| | | E | 297 | D |
| | | M | 299 | L |
| | | F | 303 | M |
| | | H | 315 | A |
| | | S | 316 | E |
| | | T | 319 | E |
| | | K | 322 | N |
| | | A | 324 | S |
| | | A | 332 | V |
| | | K | 333 | R |
| | | R | 336 | H |
| Spy1972 | 228 | V | 32 | M |
| | | L | 70 | F |
| | | M | 98 | I |
| | | K | 182 | R |
| | | F | 224 | S |
| | | D | 226 | E |
| | | H | 245 | P |
| | | P | 300 | L |
| | | R | 363 | K |
| | | K | 365 | T |
| | | T | 369 | A |
| | | A | 376 | T |
| | | R | 443 | K |
| | | V | 445 | L |
| | | A | 460 | T |
| | | V | 467 | I |
| | | D | 510 | V |
| | | A | 496 | T |
| | | T | 611 | K |
| | | T | 718 | A |
| | | G | 831 | S |
| | | A | 913 | V |
| | | Q | 930 | K |
| | | V | 1053 | A |
| | | E | 1079 | D |
| | | N | 1094 | D |
| | | T | 1102 | I |
| | | D | 1103 | G |
| | | I | 1149 | V |
| Spy2000 | 232 | K | 27 | N |
| | | S | 101 | L |
| | | V | 151 | I |
| | | D | 250 | S |
| | | P | 335 | S |
| | | A | 338 | P |
| | | V | 519 | I |
| Spy2025 | 238 | S | 33 | N |
| | | D | 46 | A |
| | | D | 49 | A |
| | | P | 54 | A |
| | | T | 78 | N |
| | | D | 107 | N |

TABLE 5-continued

Variability of antigens in strains of S. pyogenes.

| Antigen name | Seq ID | Residue in Antigen[A] | Residue number | Amino acid variations[B] |
|---|---|---|---|---|
| | | K | 109 | N |
| | | D | 112 | N |
| | | P | 119 | S |
| | | Q | 147 | P |
| | | T | 160 | I |
| | | D | 170 | E |
| | | I | 183 | N |
| | | I | 194 | A |
| | | G | 297 | E |
| | | S | 528 | R |
| Spy2191 | 244 | A | 70 | V |
| | | V | 93 | A |

SEQUENCE LISTING (301 sequences)

SEQ ID NO: 1 - DNA, 1287 bp, Streptococcus pyogenes
atgagaaaattattagcggctatgttaatgactttttttctgactcctttaccagtgattagtacagaaaaaaaacttatattttcaaaaaatgctgtttatcaattgaaacaagatgtcgttcaatcaacacaattctataatcaaataccctctaatccaaatctttatcaagaaacgtgtgcctataaagacagtgatttaactctaccagcaggaagattaggtgtaaatcaaccattacttattaaatcgcttgtgcttaacaaagaatctttaccggtttttgagttagctgatggtacctatgttgaggctaatcgacaattgatttatgacgatattgtacttaatcaagtagatatagatagctatttttggacacaaaagaaacttaggctttattcagccccttatgttttaggtacgcaaacaattccttcttcttttttatttgctcaaaaagttcatgccactcaaatggcacaaacaaaccatggaacttattatcttattgatgataagggctgggcatcacaagaagatctagttcaatttgataaccgcatgttaaaagtccaggaaatgctcttacaaaaatataataacccaaattattcaatttttgtaaagcaactcaacacacaaacaagtgctggtattaatgctgataaaaaaatgtatgctgcaagtatctcgaagttagcaccactttatattgttcaaaaacaattacaaaaaaagaaattagcagagaataaaactttgacttatactaaagatgttaatcatttttatggagactatgatccattgggaagtggtaaaattagtaaaatagctgataataaagattatcgtgttgaagacctactgaaagctgtagcacaacaatcggataatgtagcaactaatattttaggttattatctatgtcatcagtatgataaagctttccgctcagagataaaagctttatcaggtatcgattgggatatggagcagcgcttattaacttctcgttcagctgcaaatatgatggaagctatttatcatcaaaaaggccaaattatttcttacctttcaaataccgaatttgatcaacaacgtatcacaaaaaatattactgttccagttgcacataaaattggtgatgcttatgattataaacatgacgttgctattgtttacggtaatactccatttattttgtctatttttacaaataaatcaacctatgaagatattacggctattgcagatgacgtttatggtattttaaaatga

SEQ ID NO: 2 - DNA, 1197 bp, Streptococcus pyogenes
atgaaaaaaagaattttatcagcagttcttgtaagtggtgttaccctcggagcagctacaactgtaggagcggaggatttaagtactaagattgctaagcaagattctattatctcaaatctgactacagagcaaaaagctgcacagaatcaagtttcagcgttacaggctcaagtaagttcactacaatctgaacaagataaactgaccgcaagaaatacagaacttgaggcgctttcaaagcgatttgagcaagaaattaaggctctaacaagtcaaattgttgctcgtaatgaaaaattaaaaaatcaagctcgtagtgcttataaaaacaatgaaacttctggttatattaatgcacttttgaattctaaatcaatttctgatgttgtaaaccgtttagtagcaattaatagagctgtctctgctaacgctaaattgttagaacaacaaaaagctgataaagtttcccttgaagaaaagcaagctgctaaccaaacagctattaataccattgccgctaatatggcaatggctgaagaaaaccaaaatacattacgtactcaacaagctaatttggtagctgcaactgcaaatttagctctccaattagcatctgctactgaagataaagctaatttggtagctcaaaaagaagctgcagaaaaagctgctgctgaagccttagcacaagaacaggctgctaaagttaaggcacaagaacaggctgcacaacaagcagcatctgttgaagcagcaaaatctgctattactccagcaccacaagctactccggcagcgcaaagtagtaatgctattgaaccagctgcactcacggctccggcagctccttctgcaggaccacaaacatcatatgattcttctaatacttatccagttggacaatgcacatggggagctaaatctttagctccttgggcaggaaataattggggaaatggtggtcaatgggcttatagtgctcaagcagctggttatcgtactggttcaacgccgatggtaggtgcgattgccgtttggaacgatggtggttatggacatgtcgccgttgtagttgaggttcaaagtgcctcaagtattcgtgtgatggagtctaactacagtggtagacagtacattgctgaccaccgtggctggtttaatccaacaggtgttacatttatttatccacactaa

SEQ ID NO: 3 - DNA, 3774 bp, Streptococcus pyogenes
atgtcctcctattttccagtcgctcccttgtcggacttggtatcttatatgaataaacgtatttttgttgagaaaaaggctgactttggtattaaatcggctagtcttgtgaaagagttgacgcataatctacaactgacctctttgaaggctttgcgtattgtgcaggtctatgatgtcttcaatttggctgaggatttgctggcgcgtgctgagaagcatattttctctgagcaggtgacagactgtcttttgacggaaactgaaatcactgcggagcttgataaggttgccttctttgccattgaggcgcttcctggtcaatttgaccaacgtgctgctagttcgcaagaagctttgctattatttggaagtgacagtcaggttaaggtcaatacagcccagctatacttggtcaataaggatattacagaagcagagcttgaagccgttaagaactatcttttgaaccctgttgattcgcgtttcaaggacattactttgccgcttgaagagcaggctttctctgtatctgataagacgatccctaatcttgatttctttgaaacttatcaagctgacgattttgcgacttataaggcagagcagggcttggctatggaggtcgatgaccttctcttcatccaaaattatttcaaatcaatcggatgtgtgccaactgagactgagttgaaagttttggatacttactggtcagaccactgccgtcacacaacctttgaaactgaattgaagaacattgatttttcagcttctaaattccaaaaacaattgcagacaacttatgacaaatatatcgccatgcgtgatgagcttggtcgttctgaaaagccacaaacacttatggatatggcgactatttttggtcgttatgagcgtgccaacggtcgtctggacgatatggaagtctcagatgaaatcaatgcctgctcagttgagattgaagtagatgttgatggtgtgaaagagccttggctcctcatgtttaagaacgagactcacaatcacccaacagaaattgagccattcggtggagcggcgacttgtatcggtggtgctattcgtgacccattgtcaggacgttcatacgtttatcaggctatgcgtatttcaggcgcaggcgatatcacgactccgattgcggaaacacgtgctggtaaattgccacaacaagttatttctaaaactgcggcgcacggctattcttcatatggtaaccaaattgggcttgcgacaacttatgtgcgcgagtacttccaccctggcttcgtagccaaacgtatggagcttggagctgtggttggtgctgcacctaaggaaaatgtggttcgtgaaaaaccagaagcaggcgatgtggtcatcttgctcggtggtaaaacaggtcgtgatggtgtcggtggtgcgacaggttcatctaaggttcaaacggttgaatctgtggaaacagctggcgcagaggtacaaaaagggaatgccattgaagaacgtaagattcaacgtcttttccgtgatggcaatgtcactcgtcttattaagaaatcaaatgacttcggtgcaggtggtgtctgtgttgccatcggtgaattggctgacggtcttgaaatcgatttggacaaggtgcctcttaaataccaaggtcttaatggtactgaaattgcaatctcagaatctcaagagcgtatgtcagtcgttgttcgtccaaatgatgtggatgccttcatcgcagcctgcaacaaggaaaatatcgatgcagtcgttgttgcgaccgttactgaaaaaccaaatcttgtcatgacttggaatggcgaaatcatcgttgatttggaacgccgtttccttgataccaatggtgtccgtgtcgttgttgatgctaaagtcgttgacaaggacttgacagttccagaagcacgcacaacatcagcagagacacttgaagcagatacgcttaaggtcttgtctgacctcaaccacgctagtcaaaaaggtcttcaaactatctttgactcatctgttggtcgttcaaccgttaaccacccaatcggtggtcgttaccaaatcacaccgacagaaagttctgttcaaaaattgccagttcaacatggtgtgacaacaactgcatctgttatggctcaaggttacaatccttatattgcagagtggtcaccttatcacggtgctgcctatgctgtcattgaagcgacagctcgcttggtagcaacgggtgctgactggtctcgtgcacgtttctcttaccaagagtactttgagcgtatggataaacaggcagagcgttttggtcagccagtatcagctcttcttggttctattgaggctcagattcaacttggtttgccatcaatcggcggtaaggactctatgtctggtactttcgaagacttgacagtaccaccaaccttggtagctttcggcgtgacaacagcggacagccgcaaggttctctctcctgagtttaaagcggctggcgaaaacatttactatatcccaggtcaagctatttcagaagatattgattttgaccttatcaaggataactttagccagtttgaagctattcaagctcaacataagattacagctgcctcagccgctaaatacggtggtgtcctagaaagtcttgctctcatgacttttggtaaccgtatcggtgcttctgttgaaattgcagagcttgacagcagcttgacagctcaactcggaggttttgtctttacatcagctgaggaaattgctgacgcggtgaaaatcggtcaaactcaggcagactttacagtcactgtcaatggaaatgaccttgctggcgctagccttctagcagccttcgaaggcaaattggaagaggtttacccaacagaatttgagcagacagatgttcttgaagaagttcctgctgtggtatcagatactgttatcaaggctaaggaaacaattgaaaaaccagtggtttacattccagtcttccctggtaccaactcagaatacgattcagctaaggcctttgaacaggttggagctagtgtcaacttggtaccatttgtaaccttgaatgaggttgctattgctgagtcagttgacactatggttgctaatattgctaaggcaaatatcatcttctttgctggaggtttctcagcagcggatgaaccagatgggtctgctaagtttatcgtcaatatcttgcttaacgagaaggtccgcgcagctattgacagcttcatcgaaaaaggtggccttatcatcggtatctgtaatggtttccaagcccttgttaaatcaggtcttcttccatacggaaacttcgaggaagctggtgagacaagtccaactctcttctataatgatgctaatcagcatgttgccaagatggttgagactcgtatcgcaaataccaactcaccttggttggcaggagttgaggtcggcgatattcatgccattccagtttcacatggtgaaggtaaacttgttgtcagcgcttctgaatttgcagagctaagagacaatggtcaaatctggagccaatatgtggactttgacggacaaccatctatggattctaaatacaatccaaacggctctgtcaatgccatcgaagggattaccagcaagaatggtcaaatcatcggtaagatgggacactcagaacgctgggaagacggactcttccaaaatatccctggtaacaaagaccaaatcctctttgcaagtgctgtaaaatactttacagggaagtaa

SEQ ID NO: 4 - DNA, 1125 bp, Streptococcus pyogenes
atgaaaaaatttcatcgttttttggtctcaggagtaatccttttaggttttaatggtctagtacctactatgccatctacacttatttcgcaacaggaaaatcttgttcatgcagctgttttaggcgataactatccgagtaagtggaaaaaaggcaatggaatcgattcgtggaacatgtatatccgccaatgcacttcttttgcagcttttcgtttaagctctgctaatggttttcagttacctaaaggctacggtaatgcctgcacgtggggacatatcgcgaaaaatcagggttatcctgtgaataagacaccaagcataggggctatcgcttggtttgataaaaacgcttatcagtcaaatgctgcttacggtcatgtagcatgggtagctgatatccgtggagacactgtcactatcgaagagtataattacaacgctggacaaggccctgaaagataccataagcgtcaaattccaaaatctcaggtaagtggttatatccattttaaagacttatcatctcagacaagtcattcctacccaagacaactaaaacacatttctcaagcttcatttgacccctctggaacttatcactttacaaccagattaccagtcaaaggacaaaccagtatcgatagccctgatcttgcttactatgaagcaggtcaatctgtttattacgataaagtcgtgactgctggaggttatacatggcttagctacctcagtttttctggaaaccgacgctatattcccattaaagagcccgcacagtctgtggttcaaaatgacaatacaaaaccttccattaaggtcggtgatactgttaccttccctggcgtttttcgtgtagatcagcttgttaataatttgatcgttaataaagaattagccggaggagacccaactccactaaactggattgatcccacaccattagatgaaacagataaccaaggaaaagttttaggagatcaaattctccgtgtgggtgaatattttatcgtcactggtagttataaagtattaaaaattgatcaaccaagtaatggtatttatgttcaaatcggatctcgtggaacatgggtaaatgctgataaagctaacaaattatag

SEQ ID NO: 5 - DNA, 327 bp, Streptococcus pyogenes
atgattaatcaatggaacaacttacgacacaagaagctaaaaggatttactcttctagaaatgttattggtgattcttgtcatcagtgttttgatgctattatttgtgcctaatttaagcaagcaaaaagacagggttacagaaacaggtaatgccgctgttgttaaattagtggagaatcaagcagaactatatgaattatctcaaggctcaaaaccaagtttgagccagttaaaggcagatggtagtatcactgagaaacaagaaaaagcttatcaagactattatgacaaacataaaaatgaaaaagcccgtcttagcaattaa

SEQ ID NO: 6 - DNA, 771 bp, Streptococcus pyogenes
atgaaaattggcattattggtgttggcaaaatggctagcgctatcatcaaaggccttaaacaaacaccccatgaacttatcatttcaggatcatctttagaacggtccaaggaaattgcggagcagttagcactgccttatgctatgtcccaccaagaccttattgaccaggttgatcttgttattttaggcatcaagcctcaactatttgaaacggtactcaaaccgcttcacttcaaacagcctattatatctatggcagcaggcatttcccttcaacgactagcaacattcgtaggacaagaccttccgctgctacgtatcatgccaaacatgaatgcacaaattctccaaagcagtaccgctttaacgggaaatgctttggtgtcccaggaattacaagcacgtgttcgagacttaacagatagctttggtagcacatttgatattagtgaaaaggattttgacacctttaccgctttagcagggtcaagtcctgcctatatttatctctttattgaggctttggctaaggctggcgtcaagaatggcatacctaaagcaaaggcgctggagattgttactcaaacagtattggctagcgccagcaatctcaagaccagttctcaaagtccgcacgatttcattgacgctatttgtagccccggtggcacaactattgctggtctgatggagttagaacgccttggcctcacagctactgtcagctctgccattgacaaaaccatcgataaagctaaaagcttgtaa

SEQ ID NO: 7 - DNA, 1068 bp, Streptococcus pyogenes
atgacagacttattctcaaaaatcaaagaagttaccgaactggatggcattgcgggctatgaacatagcgttcgtgactacctacgcaccaaaataaccccgctggttgaccgtgttgaaacagacgggcttggtggcatttttggtatcagagatagtaaagctgaaaaagccccccgtattttagtagctgcgcacatggacgaagtcggttttatggtcagtgatatcaaagttgacggaacgctacgcgtggttggtatcggtggttggaacccacttgttgtcagttcacaacggtttaccctttacacacgcactggccaagttattccccttatttcaggatcggtacctccccattttttacgtggggcaaatggctctgctagtctaccacatatcgaagatattgtgtttgatggtggctttacggataaggcagaagctgaaagatttggtattacaccgggtgatattattatccctcaatctgaaacgatcctaacagccaatcaaaaaaatattatttcaaaagcttgggacaatcgctatggcgttctcatgataacagaaatgcttgaagcgttaaaaggacaagaccttaacaacaccctaattgcaggtgctaacgttcaagaagaagttggtctgcgcggagcccacgtctcaaccaccaagttcgaccctgaactctttttcgcagtagattgttcgcctgctggtgatatttatggcaatcctggaacaatcggagatggtaccttgttgcgtttctacgacccaggccatgtcatgctcaaagatatgcgcgacttcttactgactactgctgaggaagctggtgtcaatttccaatactattgtggcaagggaggcacagatgcaggtgctgcacaccttcaaaatggtggtgtcccatcaacaaccatcggagtctgtgcacgctacattcactctcatcaaaccctctacgctatggatgatttcgtagaagcccaagccttcttacaagccattatcaaaaaactggatcgctcaaccgttgacttgattaaatgttactaa

SEQ ID NO: 8 - DNA, 357 bp, Streptococcus pyogenes
atggaagatatttctgatccagaagttattttagagtatggggtttaccctgctttcataaaaggctatacccaattgaaagctaacatcgaagaagcattattagaaatgtcaaatagcggtcaagcattagacatttaccaagcagttcaaaccctaaacgctgaaaacatgttattaaattattacgaaagcttgccattttatttaaaccgtcaaagcatactagctaatatgaccaaagcgttaaaagatgcgcatattagagaggctatggcacattacaaattaggagaatttgctcactatcaagatactatgcttgatatggtcgaaagaacaataaaaacattttag

SEQ ID NO: 9 - DNA, 1716 bp, Streptococcus pyogenes
atgtctaataaaaaaacatttaaaaaatacagtcgcgtcgctgggctactgacggcagctcttatcattggtaaccttgttactgctaatgctgaatcgaacaaacaaaacactgctagtacagaaaccacaacgacaaatgagcaaccaaagccagaaagtagtgagctaactactgaaaaagcaggtcagaaaacggatgatatgcttaactctaacgatatgattaagcttgctcccaaagaaatgccactagaatctgcagaaaaagaagaaaaaaagtcagaagacaaaaaaaagagcgaagaagatcacactgaagaaatcaatgacaagatttattcactaaattataatgagcttgaagtacttgctaaaaatggtgaaaccattgaaaattttgttcctaaagaaggcgttaagaaagctgataaatttattgtcattgaaagaaagaaaaaaaatatcaacactacaccagtcgatatttccattattgactctgtcactgataggacctatccagcagcccttcagctggctaataaaggttttaccgaaaacaaaccagacgcggtagtcaccaagcgaaacccacaaaaaatccatattgatttaccaggtatgggagacaaagcaacggttgaggtcaatgaccctacctatgccaatgtttcaacagctattgataatcttgttaaccaatggcatgataattattctggtggtaatacgcttcctgccagaacacaatatactgaatcaatggtatattctaagtcacagattgaagcagctctaaatgttaatagcaaaatcttagatggtactttaggcattgatttcaagtcgatttcaaaaggtgaaaagaaggtgatgattgcagcatacaagcaaattttttacaccgtatcagcaaaccttcctaataatcctgcggatgtgtttgataaatcggtgacctttaaagagttgcaacgaaaaggtgtcagcaatgaagctccgccactctttgtgagtaacgtagcctatggtcgaactgtttttgtcaaactagaaacaagttctaaaagtaatgatgttgaagcggcctttagtgcagctctaaaaggaacagatgttaaaactaatggaaaatattctgatatcttagaaaatagctcatttacagctgtcgttttaggaggagatgctgcagagcacaataaggtagtcacaaaagactttgatgttattagaaacgttatcaaagacaatgctaccttcagtagaaaaaacccagcttatcctatttcatacaccagtgttttccttaaaaataataaaattgcgggtgtcaataacagaactgaatacgttgaaacaacatctaccgagtacactagtggaaaaattaacctgtctcatcaaggcgcgtatgttgctcaatatgaaatcctttgggatgaaatcaattatgatgacaaaggaaaagaagtgattacaaaacgacgttgggacaacaactggtatagtaagacatcaccatttagcacagttatcccactaggagctaattcacgaaatatccgtatcatggctagagagtgcactggcttagcttgggaatggtggcgaaaagtgatcgacgaaagagatgtgaaactgtctaaagaaatcaatgtcaatatctcaggatcaaccttgagcccatatggttcgattacttataagtag

SEQ ID NO: 10 - DNA, 429 bp, Streptococcus pyogenes
atgaaacaacaatcttaccagcctctacgcttcgtctacctcttggtggctctatttgctgctctgttgcttatagcaagacctgttatggcagatgagggaacaaatagtgctgatgcggcgtattataaagggcaaagtgctggaaaaaaagcagggaaaaaagctggaaaagaagctacttggactgatttgaccccaactgtcccaactaatccagaaacacctagtgacatcggagagactactaataaacagctctataaagaagggtataaagatgggtacaaagagggttataatgaaggctggaaatctcagtatcccgttttgactccggtcaaggttatatgggatttgatctcttattggctacagcgattattccccaataatcagtcaagtaccgcagcacaaagcatgtcataa

SEQ ID NO: 11 - DNA, 327 bp, Streptococcus pyogenes
gtgaaaaacaaattatttttagttgcccttgcgaccgtaactgtcctagggccgtctttagcaacccctcatcaccagaccgtgcatgctagtgatgtaacattaactgagacatgtgataaaaacggaacagtatgttttggctacgaaaacgtagatggtgaagtatgtaaattaacagctgacggaaagggaaccatttgtgtgggttacgaaaatagagacataaaagagagtgaaacttctagcaccaaaaatgattgttctaattggttttggtgctttttaaattatctttggactacaataaaaagctgggtttcgtaa

SEQ ID NO: 12 - DNA, 1197 bp, Streptococcus pyogenes
atggaaacaattttagaagtcaaacatctcagtaaaatttttggcaaaaaacaaaaagcagctcttgagatggtaaagactggcaaaaataagagtgagatttttaagaaaacaggcgctactgtaggtgtctatgacgctagttttgaggtcaaaaaaggtgaaatctttgttattatggggctatcaggaagtgggaaatcaacccttgtccgcatgctaaatcgtttgattgaaccttcagcaggatctatcttgctggaaggtaaagacatctcaaccatgtcagcagatcagctgcgtgaggtgcgccgccatgacattaacatggttttccaaagctttgccctctttcctcataaaaccattttggaaaataccgaatttggtttggaattacgtggcgttcccaaagaagaacgccagcgattggcagaaaaagcccttgataattcaggcctattagattttaaagaccagtacccaaaccaactatctggtgggatgcagcagcgtgtcggcctagcccgtgcgctagctaatagccctaaaattctcttaatggacgaggcattctcagcgcttgatcctttgattcgtcgtgagatgcaagatgaattacttgatttgcaagacagcatgaaacaaaccatcatctttatcagtcatgacttgaatgaagccttgcggattggtgatcggattgctttgatgaaagacggacaaattatgcaaattggtactggtgaggaaatcttgactaacccagccaatgactttgtgcgtgaattcgttgaggatgtggaccgttctaaagtcttgacagcacaaaatatcatgatcaaaccgttaacaactactgttgaattagatggacctcaagttgccttgaaccgtatgcacaacgaagaggtgtctatgttgatggcgacgaatcgccgccgccaattagtcggtagtttgacggccgatgccgctatagaggcgcgcaaaaaagggttaccgctatcagaagtgattgatcgcgatgtgagaactgtctcaaaagatactattattacagatattttgcctcttatctatgattcatctgctccgattgcagtgacagatgataataatcgtctgttaggtgtcattattcgaggacgagtgattgaagccttggctaatatctcagacgaagaccttaactaa

SEQ ID NO: 13 - DNA, 1785 bp, Streptococcus pyogenes
atgaaaacagcacgttttttctggttttattttaaacgctatcgtttctcatttactgtcattgctgttgccgttatcttagcaacttatttacaagtaaaagctcctgtcttcttaggagagtccttgactgagttgggaaaaatcggtcaggcttattacgttgctaagatgagtggccagacacattttagccctgatttatcagcttttaatgccgtgatgtttaagcttttgatgacttatttctttactgttttagctaatctaatatatagtttcttacttacacgtgttgtctcacattcgactaaccgcatgcgcaagggcttatttggtaaattagaacgtttaaccgtcgccttttttgaccgccataaagatggggagattctttctcgtttcacgagtgatttggataatattcaaaactcgctgaaccaatccttgattcaagtggtgactaatattgccctttacatcggcctggtctggatgatgtttaggcaagatagccgtttagctttgttaaccatcgcatcaaccccagttgctctcatttttttagtgattaacatccgtttggcaagaaaatacaccaatatccaacagcaagaagtcagtgctttaaatgcttttatggatgaaaccatttcaggacaaaaggctattattgtacaaggtgtccaagaagatacgatgacagcctttttaaagcataatgaaagggttcgacaagccaccttcaaacgccgtctgttctcaggacaattatttccagtcatgaatggaatgagccttattaacacggctatcgtgatttttgtcggttcaacaattgtcctcagtgacaaatctatgccagcagcggcagcgcttggtttagtggttacttttgtacaatattcccagcaatattaccaacccatgatgcaaatcgcgtctagttggggagaattgcagctggcctttaccggtgctcaccgtattcaagaaatgtttgatgaaaccgaagaagttcgtccacaaaatgcaccagcgttcaccagcttaaaagaagcagtggcgattaaccacgtcgattttgggtatcttcctgggcaaaaagttttatcagatgtgtcaatcgttgcacccaagggcaaaatgattgccgtggttggaccgacaggttctggaaagaccactattatgaacttgattaaccgtttctacgatgtggatgcaggttcgattacctttgatggccgtgatattcgtgactacgatttggatagtcttcgtcaaaaggtagggattgtgttgcaagagtcagttcttttttcaggaaccattacggataatattcgttttggtgatcagaccattagtcaagacatggttgaaactgctgcgcgtgcgacccatattcatgactttatcatgtccttaccaaaagggtacaatacctatgtctcagatgatgacaatgtcttttcaacaggtcaaaagcagttgatttctattgctaggacgctactgactgaccctgaagtgttgattttggatgaggccacttcaaatgttgatacggttaccgaaagtaaaattcaacgggccatggaagctatcgtggcaggtcgaactagctttgtcattgctcaccgcctcaaaaccattttaaatgccgatcacattattgtgttgaaagatggcaaggtcattgagcaaggaaatcatcatgagctattgcatcaaaaaggcttttatgccgaattgtatcacaatcaatttgtctttgaatag

SEQ ID NO: 14 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacataaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaatctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 15 - DNA, 1263 bp, Streptococcus pyogenes
atgacaaaagaaaaactagtggctttttcgcaagcccacgctgagcctgcttggctgcaagaacggcgtttagcggcattagaagccattccaaatttggaattaccaaccatcgaaagggttaaatttcaccgttggaatctaggagatggtaccttaacagaaaatgaaagtctagctagtgttccagattttatagctattggagataacccaaagcttgttcaggtaggcacgcaaacagtcttagaacagttaccaatggcgttaattgacaagggagttgttttcagtgatttttatacggcgcttgaggaaatcccagaagtaattgaagctcattttggtcaggcattagcttttgatgaagacaaactagctgcctaccacactgcttattttaatagcgcagccgtgctctacgttcctgatcacttggaaatcacaactcctattgaagctattttcttacaagatagtgacagtgacgttccttttaacaagcatgttctagtgattgcaggaaaagaaagtaagttcacctatttagagcgttttgaatctattggcaatgccactcaaaagatcagcgctaatatcagtgtagaagtgattgctcaagcaggcagccagattaaattctcggctatcgaccgcttaggtccttcagtgacaacctatattagccgtcgaggacgtttagagaaggatgccaacattgattgggccttagctgtgatgaatgaaggcaatgtcattgctgattttgacagtgatttgattggtcagggctcacaagctgatttgaaagttgttgcagcctcaagtggtcgtcaggtacaaggtattgacacgcgcgtgaccaactatggtcaacgtacggtcggtcatattttacagcatggtgtgattttggaacgtggcaccttaacgtttaacgggattggtcatattctaaaagacgctaagggagctgatgctcaacaagaaagccgtgttttgatgctttctgaccaagcaagagccgatgccaatccaatcctcttaattgatgaaaatgaagtaacagcaggtcatgcagcttctatcggtcaggttgaccctgaagatatgtattacttgatgagtcgaggactggatcaagaaacagcagaacgattggttattagaggattcctaggagcggttatcgctgaaattcctattccatcagtccgccaagagattattaaggttttagatgagaaattgcttaatcgttaa

SEQ ID NO: 16 - DNA, 1233 bp, Streptococcus pyogenes
atgatcaaacgattaatttccctagtggtcatcgccttattttttgcagcaagcactgttagcggtgaagagtattcggtaactgctaagcatgcgattgccgttgaccttgaaagtggcaaagttttatacgaaaaagatgctaaagaagttgtcccagtcgcctcagtcagtaagctcttgacaacctatctggtttacaaagaagtttctaagggcaagctaaattgggatagtcctgtaactatttctaactacccttatgaactcactacaaactatactattagtaacgttcctcttgataagagaaaatataccgttaaagaacttttaagtgcgttagttgttaataacgccaatagccccgctattgctttagctgaaaaaataggcggaaccgaacccaaatttgttgacaaaatgaaaaaacaattaagacaatggggcatttccgatgcaaaggtcgtcaattcaactggcttaactaaccattttttaggagctaatacttatcctaatacagaaccagatgatgaaaattgtttttgcgccactgatttagctattattgccaggcatctcttattagaatttccagaagtactgaaattatctagcaaatcctccactatttttgctggacaaaccatttacagttataattacatgcttaaaggcatgccttgttatcgagaaggcgtggatggtctttttgttggttattctaaaaaagccggtgcttcttttgtagctactagtgtcgaaaatcaaatgagggttattacagtagttttaaatgctgatcaaagccacgaggatgatttagctatatttaaaacaaccaatcaattgttgcagtaccttttaattaattttcaaaaagtccagttaattgaaaataataaaccagtaaaaacgttatatgtcttagacagtcctgaaaaaactgtcaaacttgtagcccaaaatagtttattttttatcaaaccaatacatacaaagaccaaaaataccgtccatattactaagaaatcatccacaatgatcgcacctctatcaaagggacaagtcttaggtagagcaacccttcaagataaacatcttattggacaaggttatctggatactcctccttctatcaatcttatccttcaaaaaaacatttctaaaagtttctttttaaaggtctggtggaaccgttttgtgaggtatgtcaatacctctttatag

SEQ ID NO: 17 - DNA, 927 bp, Streptococcus pyogenes
atggaatcgattgataaatctaaatttcgatttgttgagcgcgatagtgaagcctccgaagtgattgatacccctgcttattcttactggaaatcagtgtttcgtcagtttttttctaaaaaatctacagtctttatgctcgtaattttagtgacagtcttgatgatgagctttatttatccaatgtttgccaactacgactttaatgacgttagtaatatcaatgacttttcaaagcgttatatttggccaaatgcagagtactggtttggaaccgacaaaaatgggcaatctctgtttgatggtgtttggtatggggcacgtaattctattttaatctcagttatagcgacactaattaatatcaccattggggtagtgttaggagccatatggggagtttctaaagcatttgataaagttatgattgaaatttataacattatctcaaatatcccttctatgcttattatcattgttttgacctattcattaggtgcaggattttggaatttgattctagctttctgtatcactggatggattggtgtcgcctactccatccgtgttcaaatcttgcgttaccgtgatttagaatacaaccttgctagtcaaactttgggaacaccaatgtacaagattgctgttaagaacctcctgcctcaattggtttcagttatcatgactatgttgtcacaaatgctaccagtttatgtatcttctgaggccttcttatccttctttgggattggtttaccaaccaccactccaagtttaggacgttttattgctaattattcaagcaacttaacaacaaatgcctacctcttttggattcccttagtaacattgattttagtatcgttaccactatacattgtcggacaaaacttggctgatgccagtgacccacgttcacatagatag

SEQ ID NO: 18 - DNA, 1575 bp, Streptococcus pyogenes
ttggctttgaccgattttaaggataaagaccaacaagatcagcagcgaagctttaaagagcagattcttgctgagttggaaaaagcaaatcaaatcagaaaagaaaaagaggaagaactttttcaaaaagagttggaagctaaagaagcagctaggagaacggcccagctatatgctgaatataaaagacaagatgcttttcaaaaagagtctatagcacataacaataagacagctaaacactttcaagctataaaaggtgcggtaatgacttcagaagcgcttaaaccgactttactttctgaaaaagaaaactcatctttaaaaacgacaaataagagagtcgtgcaggcaaatgagcttcaagagactgcctctaaagaatctcaagtaccgttaactattgagaaaggtcattcagtgagacgaaaattaagcaaacgccaacagactgagcgagctgctaaaaagatttcaaccgttttgattagttctattattataacccttttggctgttactctagcaggagcaggctatgtttatagtgctttaaatcctgttgataaaaatagtgatgcctttgttcaagttgagattccatctgggtcaggcaataaattgattggtcaaattcttcaaaaaaaaggtttaatcaagaatagcactgtttttagtttttatacaaaatttaaaaactttacaaattttcagagcgggtattataatctgcaaaaaagtatgagtctagaagaaattgctagtgctttacaagaaggtggtacagcagaacctaccaagccatctcttgggaagatcttgattccagaaggatacacgattaaacaaatagctaaagctgttgagcataatagcaagggaaagaccaaaaaagctaaaacaccttttaacgagaaggattttttggatttagtcacggatgaggcttttattcaagatatggtaaaaagatatccaaaattattagcaactatcccaactaaagaaaaagctatttaccgtttggaaggttaccttttcccagcaacctataactattacaaagaaactaccatgagagaacttgtagaggacatgctggcagctatggatgctactttggtaccctattatgataaaattgctgctagtggtaagacagtcaacgaggtattgaccttggcctctttggttgaaaaagaaggttcaacagacgatgacagacgtcaaattgcaagtgtcttttataaccgccttaatagcggaatggcactacaatctaatatagctattttgtatgcgatggggaaacttggtgagaaaacaaccttggctgaggatgctactattgacaccaccattaattctccttataatatttataccaatacaggtctgatgcctggtccagttgctagctcgggggtttctgcaattgaagcaaccctaaatccagcctcaacggattatttatactttgtggccaatgtccatactggtgaagtttactatgcaaaaacatttgaagaacactctgcaaatgttgaaaaatatgtgaatagtcaaattcagtaa

SEQ ID NO: 19 - DNA, 4944 bp, Streptococcus pyogenes
gtggagaaaaagcaacgtttttcccttagaaaatacaaatcaggaacgttttcggtcttaataggaagcgttttcttggtgatgacaacaacagtagcagcagatgagctaagcacaatgagcgaaccaacaatcacgaatcacgctcaacaacaagcgcaacatctcaccaatacagagttgagctcagctgaatcaaaatctcaagacacatcacaaatcactctcaagacaaatcgtgaaaaagagcaatcacaagatctagtctctgagccaaccacaactgagctagctgacacagatgcagcatcaatggctaatacaggttctgatgcgactcaaaaaagcgcttctttaccgccagtcaatacagatgttcacgattgggtaaaaaccaaaggagcttgggacaagggatacaaaggacaaggcaaggttgtcgcagttattgacacagggatcgatccggcccatcaaagcatgcgcatcagtgatgtatcaactgctaaagtaaaatcaaaagaagacatgctagcacgccaaaaagccgccggtattaattatgggagttggataaatgataaagttgtttttgcacataattatgtggaaaatagcgataatatcaaagaaaatcaattcgaggattttgatgaggactgggaaaactttgagtttgatgcagaggcagagccaaaagccatcaaaaaacacaagatctatcgtccccaatcaacccaggcaccgaaagaaactgttatcaaaacagaagaaacagatggttcacatgatattgactggacacaaacagacgatgacaccaaatacgagtcacacggtatgcatgtgacaggtattgtagccggtaatagcaaagaagccgctgctactggagaacgctttttaggaattgcaccagaggcccaagtcatgttcatgcgtgtttttgccaacgacatcatgggatcagctgaatcactctttatcaaagctatcgaagatgccgtggctttaggagcagatgtgatcaacctgagtcttggaaccgctaatggggcacagcttagtggcagcaagcctctaatggaagcaattgaaaaagctaaaaaagccggtgtatcagttgttgtagcagcaggaaatgagcgcgtctatggatctgaccatgatgatccattggcgacaaatccagactatggtttggtcggttctccctcaacaggtcgaacaccaacatcagtggcagctataaacagtaagtgggtgattcaacgtctaatgacggtcaaagaattagaaaaccgtgccgatttaaaccatggtaaagccatctattcagagtctgtcgactttaaagacataaaagatagcctaggttatgataaatcgcatcaatttgcttatgtcaaagagtcaactgatgcgggttataacgcacaagacgttaaaggtaaaattgctttaattgaacgtgatcccaataaaacctatgacgaaatgattgctttggctaagaaacatggagctctgggagtacttatttttaataacaagcctggtcaatcaaaccgctcaatgcgtctaacagctaatgggatggggataccatctgctttcatatcgcacgaatttggtaaggccatgtcccaattaaatggcaatggtacaggaagtttagagtttgacagtgtggtctcaaaagcaccgagtcaaaaaggcaatgaaatgaatcatttttcaaattggggcctaacttctgatggctatttaaaacctgacattactgcaccaggtggcgatatctattctacctataacgataaccactatggtagccaaacaggaacaagtatggcctctcctcagattgctggcgccagccttttggtcaaacaatacctagaaaagactcagccaaacttgccaaaagaaaaaattgctgatatcgttaagaacctattgatgagcaatgctcaaattcatgttaatccagagacaaaaacgaccacctcaccgcgtcagcaaggggcaggattacttaatattgacggagctgtcactagcggcctttatgtgacaggaaaagacaactatggcagtatatcattaggcaacatcacagatacgatgacgtttgatgtgactgttcacaacctaagcaataaagacaaaacattacgttatgacacagaattgctaacagatcatgtagacccacaaaagggccgcttcactttgacttctcactccttaaaaacgtaccaaggaggagaagttacagtcccagccaatggaaaagtgactgtaagggttaccatggatgtctcacagttcacaaaagagctaacaaaacagatgccaaatggttactatctagaaggttttgtccgctttagagatagtcaagatgaccaactaaatagagtaaacattccttttgttggttttaaagggcaatttgaaaacttagcagttgcagaagagtccatttacagattaaaatctcaaggcaaaactggtttttactttgatgaatcaggtccaaaagacgatatctatgtcggtaaacactttacaggacttgtcactcttggttcagagaccaatgtgtcaaccaaaacgatttctgacaatggtctacacacacttggcacctttaaaaatgcagatggcaaatttatcttagaaaaaaatgcccaaggaaaccctgtcttagccatttctccaaatggtgacaacaaccaagattttgcagccttcaaaggtgttttcttgagaaaatatcaaggcttaaaagcaagtgtctaccatgctagtgacaaggaacacaaaaatccactgtgggtcagcccagaaagctttaaaggagataaaaactttaatagtgacattagatttgcaaaatcaacgaccctgttaggcacagcattttctggaaaatcgttaacaggagctgaattaccagatgggcattatcattatgtggtgtcttattacccagatgtggtcggtgccaaacgtcaagaaatgacatttgacatgattttagaccgacaaaaaccggtactatcacaagcaacatttgatcctgaaacaaaccgattcaaaccagaacccctaaaagaccgtggattagctggtgttcgcaaagacagtgtcttttatctagaaagaaaagacaacaagccttatacagttacgataaacgatagctacaaatatgtctcagtagaagacaataaaacatttgtggagcgacaagctgatggcagctttatcttgccgcttgataaagcaaaattaggggatttctattacatggtcgaggattttgcagggaacgtggccatcgctaagttaggagatcacttaccacaaacattaggtaaaacaccaattaaacttaagcttacagacggtaattatcagaccaaagaaacgcttaaagataatcttgaaatgacacagtctgacacaggtctagtcacaaatcaagcccagctagcagtggtgcaccgcaatcagccgcaaagccagctaacaaagatgaatcaggatttctttatctcaccaaacgaagatgggaataaagactttgtggcctttaaaggcttgaaaaataacgtgtataatgacttaacggttaacgtatacgctaaagatgaccaccaaaaacaaacccctatctggtctagtcaagcaggcgctagtgtatccgctattgaaagtacagcctggtatggcataacagcccgaggaagcaaggtgatgccaggtgattatcagtatgttgtgacctatcgtgacgaacatggtaaagaacatcaaaagcagtacaccatatctgtgaatgacaaaaaaccaatgatcactcagggacgttttgataccattaatggcgttgaccactttactcctgacaagacaaaagcccttgactcatcaggcattgtccgcgaagaagtcttttacttggccaagaaaaatggccgtaaatttgatgtgacagaaggtaaagatggtatcacagttagtgacaataaggtgtatatccctaaaaatccagatggttcttacaccatttcaaaaagagatggtgtcacactgtcagattattactaccttgtcgaagatagagctggtaatgtgtcttttgctaccttgcgtgacctaaaagcggtcggaaaagacaaagcagtagtcaattttggattagacttaccggtccctgaagacaaacaaatagtgaactttacctaccttgtgcgggatgcagatggtaaaccgattgaaaacctagagtattataataactcaggtaacagtcttatcttgccatacggcaaatacacggtcgaattgttgacctatgacaccaatgcagccaaactagagtcagataaaatcgtttcctttaccttgtcagctgataacaacttccaacaagttacctttaagataacgatgttagcaacttctcaaataactgcccactttgatcatcttttgccagaaggcagtcgcgttagccttaaaacagctcaagatcagctaatcccgcttgaacagtccttgtatgtgcctaaagcttatggcaaaaccgttcaagaaggcacttacgaagttgttgtcagcctgcctaaaggctaccgtatcgaaggcaacacaaaggtgaataccctaccaaatgaagtgcacgaactatcattacgccttgtcaaagtaggagatgcctcagattcaactggtgatcataaggttatgtcaaaaaataattcacaggctttgacagcctctgccacaccaaccaagtcaacgacctcagcaacagcaaaagccctaccatcaacgggtgaaaaaatgggtctcaagttgcgcatagtaggtcttgtgttactcggacttacttgcgtctttagccgaaaaaaatcaaccaaagattga

SEQ ID NO: 20 - DNA, 555 bp, Streptococcus pyogenes
atgaaatggagtggttttatgaaaacaaaatcaaaacgctttttaaacctagcaaccctttgcttggccctactaggaacaactttgctaatggcacatcccgtacaggcggaggtgatatcaaaaagagactatatgactcgcttcgggttaggcgatttagaagatgattcagctaactatccttcaaatttagaagctagatataaaggatatttagagggatatgaaaaaggcttaaaaggagatgatatacccgaacggcccaagattcaggttcctgaggatgttcagccatctgaccatggcgactatagagatggttatgaggaaggatttggagaaggacaacataaacgtgatccattagaaacagaagcagaagatgattctcaaggaggacgtcaagaaggacgtcaaggacatcaagaaggagcagattctagtgatttgaacgttgaagaaagcgacggtttgtctgttattgatgaagtagttggagtaatttatcaagcatttagtactatttggacatacttaagcggtttgttctaa

SEQ ID NO: 21 - DNA, 633 bp, Streptococcus pyogenes
atgaaaaagacattaactttgctactggcactctttgccatcggggtaactagtagcgtcagagcggaggatgaacaaagtagtacacaaaagccagtaaaatttgatttggatggacctcaacaaaaaattaaagattatagtggcaacacaatcactctagaagacttatatgttggtagtaaagtagtaaaaatatatatccctcaaggatggtgggtatatctttacagacaatgtgatcataacagtaaagaacgaggaattttagctagtcctattctcgaaaaaaatataacaaaaacagatccttatcgtcaatattatacaggagtaccttatattcttaacttaggagaagatcctttgaagaaaggagaaaaattaactttctcatttaaaggagaagacggattttatgtcggtagctatatctatagagactctgatactataaaaaaagaaaaagaagctgaagaagcacttcaaaaaaaggaagaggaaaagcaacaaaaacagctagaagaaagcatgctaaagcagataagagaagaagaccataaaccttggcatcagcggttaagtgagagcatccaagatcagtggtggaactttaagggactgtttcagtga

SEQ ID NO: 22 - DNA, 615 bp, Streptococcus pyogenes
atgaaaaaaacattaaccttgctactggcactctttgccatcggggtaactagtagcgtcagagcggaggatgaacagaataagtttatacttgatggattacaggaaaaagtaaaagaagttagtgtatcagatttttctgttggagaatctaaaatcaaagtctggcttcctcaagcttggtcggtcaaaatttctagagaacattcaccaaaatcaagcatttctaattctggagaacaaaaacctttaagcaatagctcagagaataaagaaggtcaattttctaaaagattaccttatggtacccaacatactattaaattatcatcccaacttacaaaaggtgagagagtcactttgacattcagagatgaagatttttggggagcaggttactgcttctatagagattcactatccataaaagaagacaaacaatacgaagaagaaattaagaaaattgaggatgacctagagagacaagatcttgaaaatgatgcactagagatgtttaaaaaacaaaccgaaagagaggctaataaaccttggcatcagcggttaagcgaaaacatccaagatcagtggtggaactttaagggactgtttcagtga

SEQ ID NO: 23 - DNA, 1170 bp, Streptococcus pyogenes
atgattattactaaaaagagcttatttgtgacaagtgtcgctttgtcgttagtacctttggcgacagcgcaggcacaagagtggacaccacgatcggttacagaaatcaagtctgaactcgtcctagttgataatgtttttacttatactgtaaaatacggtgacactttaagcacaattgctgaagcaatggggattgatgtgcatgtcttaggagatattaatcatattgctaatattgacctaatttttccagacacgatcctaacagcaaactacaatcaacacggtcaggcaacgaatttgacggttcaagcacctgcttctagtccagctagcgttagtcatgtacctagcagtgagccattaccccaagcatctgccacctctcaaccgactgttcctatggcaccacctgcgacaccatctgatgtcccaacgacaccattcgcatctgcaaagccagatagttctgtgacagcgtcatctgagctcacatcgtcaacgaatgatgtttcgactgagttgtctagcgaatcacaaaagcagccagaagtaccacaagaagcagttccaactcctaaagcagctgaaacgactgaagtcgaacctaagacagacatctcagaagccccaacttcagctaataggcctgtacctaacgagagtgcttcagaagaagtttcttctgcggccccagcacaagccccagcagaaaaagaagaaacctctgcgccagcagcacaaaaagctgtagctgacaccacaagtgttgcaacctcaaatggcctttcttacgctccaaaccatgcctacaatccaatgaatgcagggcttcaaccacaaacagcagccttcaaagaagaagtggcttctgcctttggtattacgtcatttagtggttaccgtccaggtgatccaggagatcatggtaaaggtttggccattgattttatggtgcctgaaaattctgctcttggtgatcaagttgctcaatatgccattgaccatatggcagagcgtggtatttcatacgttatttggaaacagcgattctatgcgccatttgcaagtatttacggaccagcctacacatggaaccccatgccagatcgcggcagtattacagaaaaccattatgatcatgttcatgtctcctttaatgcttaa

SEQ ID NO: 24 - DNA, 996 bp, Streptococcus pyogenes
ttgcggcagattcagtccattcgtctgatagacgttttggagttggcttttggagttggctataaggaagaaacaacctctcagttttcttcggatcagccctcccaagtggttttgtatcgaggtgaggctaacacggttaggtttgcctataccaatcagatgtctctgatgaaagatattcgcattgctttggatggttctgataagtctttgaccgctcagattgttcctggtatgggtcatgtttatgagggctttcaaacttctgctagagggatttttacgatgtcaggagttcctgaaagcactgttcccgttgctaaccctaatgtacaaaccaaatatataaggtatttcaaagtcattgatgatatgcataacacaatgtataaaggaactgtttttcttgttcaaccgcaagcttggaaatacaccatgaaatctgttgatcagttaccagtagatgacttgaaccatattggcgttgctggtattgaacgaatgacaactctcattaaaaatgcgggtgcccttttaaccacaggaggtagtggggctttcccagacaatattaaagtatctattaatccaaaggggaggcaggccacgattacttatggggacggctctacggatattattcctccagcagttttatggaaaaaaggctccgtaaaagagcctactgaagccgatcaatctgtcggaacaccgactcctggtattcctggtaaattcaaacgagaccagagccttaacgagcatgaagctatggtaaatgtcgaaccactgtctcatgtagtaaaagacaatataaaggtcatagatgaaaaatcaacagggcggtttgagccttttagacctaatgaagatgagaaggagaagcctgccagcgatgttaaggtaagaccagcagaagttggtagctggctagaaccagcgacagctcttcctagtgttgaaatgagcgctgaggacaggttaaaaagttag

SEQ ID NO: 25 - DNA, 999 bp, Streptococcus pyogenes
atgaaagtcttattgtatttagaagcagaaaattatctaagaaaatcaggaattggtcgagcgattaagcatcaggctaaagccttgtcacttgttggtcaacattttacgactaatccaagagaaacttatgatttggttcatctcaatacctatggtttaaaaagttggctgctgatgataaaagcacaaaaagctggtaagaaggttatcatgcatgggcattctacagaagaagattttagaaattcttttattttttcaaatctattatctccttggtttaaaaaatacctttgtcacttttacaataaggcagatgctatcattacccctaccctatattctaagtctttgattgagagttatggagtgaagtcacctatttttgcagtgtcaaatgggattgatttggagcagtacggagcagatcctaaaaaggaagcagcttttcgtcgctactttgacattaaagagggtgaaaaagtggttatgggagcaggattattttttctgaggaaaggaattgatgactttgtcaaagttgcccaagctatgccagatgttcgttttatctggtttggcgagaccaacaaatgggtcattcctgctcaagttcgccaaatggtcaatggtaaccacccgaaaaatcttattttcccaggatacattaaaggggatgtttatgaaggtgccatgactggtgcagatgcctttttctttccaagtcgtgaagaaacagaaggcattgttgtcttagaagccttggccagtcgccagcaccttgttttacgtgatataccagtttactacggatgggttgatcaaagtagtgcggaattagcaaccgatataccaggttttatagaagctctgaaaaaagtcttttctggtgccagcaacaaagttgaagctggttacaaggttgcccagagtcgtcgcctagaaacggttggccatgccttagtagatgtctataaaaaagtaatggagttataa

SEQ ID NO: 26 - DNA, 2133 bp, Streptococcus pyogenes
atggaaaataacaataatcacaacattgcagaggctttgtcagttagtctccatcaaattgaacaggtgcttgccctaacagcacaaggcaataccattccctttattgcacgttaccgtaaagaagtaacaggaaatctagatgaagtggtgattaagtccattattgatatggataagtctctcactaccctgaatgagcgcaaagcaaccattctcgctaaaattgaggaacagggaaaactgacagatcagttacgaacgagtattgaagcaaccgagaaactcgctgatttggaagagttgtacctgccttataaggaaaaacgccgtacaaaagcgacgattgcgcgtgaagcaggcttgttcccattagcacgtttgattttacaaaatgcgcaaaaccttgaaacagcagcagaaccctttgtcacagaaggatttgccagcccacaagaagctctagcaggagctgtggacatccttgtggaggccatgtcagaagatgctaaattacgctcttggacctacaatgagatttggcagtacagccgcttagtatcaacgcttaaagatgagcagttggatgagaaaaaggttttccaaatctattacgatttttctgaccaagtgtctaacatgcaaggatatcgtactttagcccttaaccgtggcgaaaagttaggcatcttaaaagtgtcttttgagcataacttggagaaaatgcaacgctttttcagtgtgcggttcaaagaaaccaacccttatattgaagaggtcatcaatcagaccatcaaaaagaaaattgttccagctatggaaagacgggttcgttcagaactcagtgatgccgcagaagatggggctatccacctcttttctgaaaatctccgtcatcttttgttagtgtctcctttaaaagggaaaatggttcttgggtttgaccctgcctttcgaacaggtgcaaaattggctatcgttgatcagactggaaaattgttgactactcaggttatttatcccgtagcaccagctagccaaacgaagattcaagcagctaaagaaacactgactcagctcattgagacttaccagattgatattattgccattggaaacggaacagccagtcgggaaagtgaagcctttgtagcagacgttttgaaagatttcccaaatacgtcctatgtcatcgttaacgaaagcggtgcttctgtttattcagcgtcagagttagcccgccatgagtttccagacctcacagtggagaagcgctctgctatttctattgctcgtcgcttgcaagacccactcgcagaattggttaaaattgatcctaaatctattggcgtcggtcagtaccagcacgatgtgagtcagaaaaagttgagtgagaatcttggttttgttgtggatactgtggttaaccaagtcggtgttaatgtgaacacggctagtccatctttattagcacatgtgtcaggtttgaacaaaacgatttcagaaaatattgtcaaataccgcgaagaaaatggagcactgacatcacgcgctgacatcaaaaaagtgccgcgtttaggagccaaggcgtttgagcaagcagcaggttttctcagaattccaggagccaaaaatattttagacaacacaggagttcaccccgagtcctacccagcagtcaaagaactctttaaggtacttggtattcaggacttggacgacgctgccaaggcaactttagcagcagttcaagttccccaaatggcagaaacattggctattgggcaggaaacccttaaagatatcattgctgatctccttaaaccgggtcgtgaccttcgtgatgactttgaagcaccaatcttacgtcaagatatccttgatttgaaagatttggaaattggccagaagcttgaaggaactgtgagaaacgtcgttgactttggtgcttttgtagacattggtgttcatgaagatgggcttattcacatttctgaaatgagcaaaacctttgtcaaccaccctagtcaagttgtttcagtgggtgacttggtaactgtttgggtctctaagattgacttggaccgccacaaggtcaatctcagcctattgccaccgcgtgacactcactaa

SEQ ID NO: 27 - DNA, 1302 bp, Streptococcus pyogenes
atgaatgaaaaagtatttcgtgaccctgttcacaactatatccacattgataatccattaatttatgaccttatcaataccaaagaattccaacgcttacgacgcatcaaacaagtccctacaacagctttcaccttccacggcgcagaacatagccgtttttctcactgcctaggtgtttacgaaattgcccgtcgggtgacagctatttttgaagagaaatacgctgatatctggaataaagatgaaagtctggtcactatgacggctgccctcttacatgacattggtcatggagcctattctcatacctttgaggttctttttcatacggatcacgaggcctttactcaggagataattaccaatcctgagacagaaatcaatgccattttggtgcgtcatgctcctgattttccagacaaagttgccagcgtgattaatcatacttatcctaacaagcaagttgtgcaactgatttccagccagattgactgcgaccgtatggattaccttttaagagattcttatttttctgctgccaattacggtcagtttgatttaatgcgcatcctacgtgtgattcgacctgttgaagatggcattgtctttgaacatagtggtatgcatgctgtcgaggactatattgtcagtcgttttcaaatgtacatgcaggtctattttcatcccgccagccgtgctgttgagctcatcttacaaaatctcctcaaaagagcccaacacttatatcctgagcaacaggcttatttccaaaaaacagctcctggactcatccccttctttgaaaagaaggctaatttagcagattatatagccctagatgacggagtcatgaatacttacttccaagtctggatggcaagcgaagaccatatcttatcagatttggccagtcgctttattaatcgaaaaattctgaagtctgttacctttgaccaagattcccaaggagagttagaacgcttgcgccaattggtcgaatcagttggctttgatccagattattacaccggtatccatatcaacttcgacctgccttatgatatttatcgaccagagctcgaaaatccaagaactcagattgaaatgatgcaaaaagacgggagccttgctgaattatctcagttatctcctattgtcaaagcattaacagggacaacctacggagaccgtcgcttttattttccaaaggaaatgttagagctcgatgacctctttgctcctagcaaggaaacttttatgagttatatttccaatgggcattttcactttagtcagtaa

SEQ ID NO: 28 - DNA, 783 bp, Streptococcus pyogenes
atggatatcaatttgttacaggcacttttaattggtctttggacagccttttgtttcagcggaatgttacttggcatctacaccaaccgttgtattattctgtcttttggtgtagggattatcttaggtgacttgccaactgcacttagcatgggagctatctccgaattagcttatatgggatttggagtgggtgccggtggtaccgttcctcctaatcctatcggccctggtatctttggtaccttgatggctattaccagtgctggtaaagtcaccccagaagcggcactagccttatcaacaccaatcgcagttgccatccaattccttcaaacattcgcctatacagcttttgctggcgctcccgaaaccgctaaaaaacaattgcaaaaaggcaatattagaggcttcaaattcgctgccaacggcactatctgggctttcgcttttatcggattaggccttggtttattaggtgccttgtcaatggatactctccttcacttggttgattatatcccacctgtcttgctcaatggattgactgtcgctggtaaaatgttacctgctatcggatttgccatgatcttatctgttatggccaagaaagaattgattccttttgtactaattggttatgtttgtgcagcctacctccaaattccaaccattggtatcgccattattggtatcattttcgccttgaatgaattttacaacaaacctaaacaagtcgatgcaacaactgtccaaggaggccaacaagatgactggatctaa

SEQ ID NO: 29 - DNA, 1212 bp, Streptococcus pyogenes
ttgacccctcgtagcggaaagaccacagctgggcattttcgttatgctaggtatctgattgagtcagaagatgaaaatcaccttgtgactgcttataatcaagaacaagcttatcgtttgtttatcgacggcgatggtacgggtttgatgcatatatttgacggtaactgtgaaataaaacacgacgagcgtggagatcacttgttaatcacgacaccaaaaggcaataagcgcgtttattataaaggcggcggtaaagttaacagtgttggtgctattacaggtatgtctttaggatcagtagtattctgcgagattaacttactgcacatggattttatccaggagtgttttaggcgtacttgggcggctaagctacgttatcatctagcagatttaaatcccccagcacctcaacatccagtaattaaagatgtctttgatgttcagaacacgaggtggactcattggaccatggatgataacccaatactaaccgcagagcgtaaacaaaacattatcaacagtcttaaaaaaaatccatatctatacaaacgagatgtacttggacagcgggtcatgcctcagggagttatttatggcctttttgacacggaaaaaaatgttttggatgctttgattggcgaaccagtagagatgtatttctgtgcagatggaggtcaatcagatgccacctctatgtcttgtaatatcgtaacaagagttagagataacggtaggataagcttcagacttaatcgtgtagctcactactaccacagcggagctgacactggccaagtaaaagctatgtcaacctacgctttagagttaaaagtttttatagactggtgcgttaaaaagtatcagatgcgctatacagaggtatttgtggatcctgcctgtaaatctttgagagaggagctgcataagttaggagtatttactctgggagctccgaacaattctaaagatgtatctagcaaagcaaaaggtattgaggtcggtatcgaacgcggccaaaacattatctcagatggcgctttttatcttgttaatcatagcgaagaagagtatgaccactaccactttttaaaagagatagggctgtacagtcgtgacgacaatggcaaacctattgataaagataaccatgccatggacgagtttagatacagcgtcaacgtgtttgtgcatcggtattacaactaa

SEQ ID NO: 30 - DNA, 1494 bp, Streptococcus pyogenes
atgaaaaagaagcctattaagttaaatgacgaacagcttcttttggaagctagtcagttatctgatatgtatcatcagctgactcttgatttatttgatcaagtgattgagaggataaaagccagaggctcagcgagcttagccgataatccttatctttggcaagctaataagttacatgacgttggactgcttaatgcagataacatcaagcttattgcaaagtattctggcattgcggaagctcaacttcgctatattatcaagaatgaaggatttaaaatttataaaaacacgtctgagcagctagaagaggctctaggtagagagtctggggtaaacagtactatccaagacgacctatctaactatgctagacaagctattgatgatgtgcataatttgactaacaccaccttgccatttagtgttataggagcttatcaagggataatccaagacgctgttgctggtgtggtgacaggcttaaaaacgcctgaccaagctatcaatcaaactgtgattaaatggtttaaaaaggggttttatggttttacagataaagctgggagaaagtggagagcagactcttatgctcgtaccgttatcaatactacgacttggcgagtctttaacgaagccaaagaagcccctgctagggagtttggcattgataccttctattactcaaaaaaagctacagctagagagatgtgtgcacctttgcaacatcaaattgtcactactggcgaagcgagagaagaaggagggataaaaatcttagctttatctgattacgggcatggtgagcctgatggatgcttgggaatcaactgcaagcacactaaaacgccgtttgtcgtcggtgtgaatagtaagccagaattgccagagcatctaaaaaatatcactcctgcacaagctaaagctaatgcgaatgcgcaagctaagcagagggcaatcgagagatcaatacgtaagagtaaagagctactgcacgttgcgaagcaattgggtgataaagagttgattaggcaatatcaatcggatgttagaagtaaacaagatgcactcaattatctgataaacaacaatgcctttttacatcgcaatcaagccagagaaaagcgttacaataatccttataccaaaactcaaagtgaagtcgaagttagaaaagaaaaagctaaattagataaacgtagggatgttgaaagtgctataataggagtagaaactagtgaagggataccgctaaaaataacaaagcatttagccgaaagggcggtgctgagaaatatagcacctattgatattgtcgattctataaaagaaccgttgaagatagctcctattaagtacgataaccttgatagaccttcccagaaatacattggtaagtgtgtctcgacagtaataaacccgatagacggaaatattgttacagttcatgctactagcacgagaatccgcaaaaaatatggaggaaattga

SEQ ID NO: 31 - DNA, 1887 bp, Streptococcus pyogenes
atgagcagagacccaacacttattttagacgagtcaaacctcgttattggtaaggatggacgtgtgcattacacatttaccacagaggacgacaacccaaaagtcagactagctagcaagtgtctaggcacagcgcattttaatcagctcatgattgagcgaggagaccaagctactagctatgttgcgccagtagtagttgagggtacaggtaatccgactggactatttaaagacctcaaagagattagcttagagctgacagatactgctaattcccagctttggtcaaaaatcaagctgactaaccgtggtatgttgcaggaatactacgacggtaagatcaagaccgagatagtcaactccgccagaggtgtcgctacacgtatcagcgaggatactgataaaaagctagcgctcatcaatgacaccattgatggtatcaggcgtgagtatcgagatgctgataggaagctatccgcaagctatcaggcaggcatcgaggggctaaaagccacaatggccaatgataaaatcggtttacaagctgagattaaagcctcagcacaagggctatcgcaaaagtatgatgatgagttgcgcaagctatcggctaagatcacaacaacctcaagcggcactacagaggcctacgagagtaagcttgcgggcttacgtgctgagtttactcgctcaaatcaaggcacgaggacagagctcgagtcacaaattagcgggctaagagcggtacagcagtcaacagctagccaaatctctcaagagattagagaccgtgaaggtgctgtcagtcgtgtgcagcagagtttggagagttaccaaaggcggatgcaggacgcagaagaaaactatagtagcttgacccatacggttagagggctacagagcgacgttggatctccgactggtaaaatccaatcgcgccttactcaactagcaggacaaattgagcagcgggttactagagatggtgtcatgagtattattagtggcgctggagacagcattaaattagctatccaaaaggctggcggcattaatgccaaaatgtctggtaatgagattatctcagcaattaacctcaactcctacggagtaacaatcgcaggtaaacacatcgctctcgatgggaatacgacggttaatggcacctttaccacaaaaatagccgaggctatcaagattagggctgatcagattattgcaggcacgattgacgctgctaggattagagtgattaaccttaacgcaagtagtatcgttggtttagacgctaactttatcaaagctaaaattggctatgctatcactgatttgctcgagggtaaggtcattaaggctcgtaatggagcgatgcttatcgacttaaatacagctaagatggactttaatagcgatgccacaattaattttaatagcaaaaacaatgccttagtacgtaaagatggcacacatactgcctttgtacattttagtaatgcgacgcccaaaggttatacagggtcagcgttgtatgcatcgatcgggataacctcatctggtgacggtgttaactcggcttcttccggtcgttttgcagggctaaggtcatttaggtacgctacgggatataatcacactgcggcagtcgaccagactgaaatttacggtgataatgttttagttgtggatgattttaatattactcggggatttaagtttagaccagacaagatgcaaaaaatgcttgacatgaacgacttgtatgcggctgtagtagccttaggccgctgttgggggcacttggctaacgtcggctggaatactgctcatagcaattttacaagtgctgtgaatagggaattgaataactacatcacaaaaatttaa

SEQ ID NO: 32 - DNA, 1203 bp, Streptococcus pyogenes
atgacctttttagataaaattaaacaaggctgtttagatggctgggctaagtacaaaatcttgccatccttgaccgcagcacaagctatcttagagagcgggtggggcaaacatgccccacacaacgctctgtttggtattaaggcagatagctcttggactggtaaatcatttgataccaaaacccaagaggaatatcaagcaggtgttgtcacggatattgtggaccgatttagggcgtatgatagttgggatgagtcgatagctgatcacggacaatttttagttgataatccacgctatgaggcagttattggggagactgactataaaaaggcttgttacgctattaaagcagctggatacgctacggcaagtagctatgtcgaacttttaatccaactgattgaggaaaacgacttacaaagttgggatagagaagctcttaaaaataataaggaggaaacgatgacaaccgcaaacgaaattgtacaatactgtgttaaccttgctaattcaggcatgggtgttgacaaagacggtgctcacgggacgcaatgctgtgacttgccttgttttgtcgctaaaaattggtttggtgttgatctttggggcaatgcgattgatttattagacagcgcaagtgcgcaaggctgggaagtccatcgtatgccaacagaggcaaacccaaaagcaggcgctacatttgtccaatcagtgccgtatcatcaatttggacatacgggaattgttatcgaggatagtgacggttacaccatgcgcactgtcgagcaaaacattgatggcaatcctgatgctttgtatgtcggtgcaccagctcgttttaacactcgtgactttactggcgtgataggttggttttacccaccatatcaaggggatacagtcacgcaaccagtcagcaccgagccgcaaacttctgacactatcgtagagacagcaaaaacaggcacctttacccttgatgttgcagagatcaatatcagacgctggccaagtctagccagcgaggttgtaggtatctacaagcaaggtgatactgtcagctttgatagcgagggctacgctaatggctattattggattagctatgttggaggctcaggtatgcgtaactacctaggtattggacagactgataaagatgggaatcgcatcagcctttggggtaaattaaattag

SEQ ID NO: 33 - DNA, 708 bp, Streptococcus pyogenes
atgaaaaagattaacatcatcaaaatagttttcataattacagtcatactgatttctactatttcacctatcatcaaaagtgactctaagaaagacatttcgaatgttaaaagtgatttactttatgcatacactataactccttatgattataaaaattgcagggtaaatttttcaacgacacacacattaaacattgatactcaaaaatatagagggaaagactattatattagttccgaaatgtcttatgaggcctctcaaaaatttaaacgagatgatcatgtagatgtttttggattattttatattcttaattctcacaccggtgagtacatctatggaggaattacgcctgctcaaaataataaagtaaatcataaattattgggaaatctatttatttcgggagaatctcaacagaacttaaataacaaaattattctagaaaaagatatcgtaactttccaggaaattgactttaaaatcagaaaataccttatggataattataaaatttatgacgctacttctccttatgtaagcggcagaatcgaaattggcacaaaagatgggaaacatgagcaaatagacttatttgactcaccaaatgaagggactagatcagatatttttgcaaaatataaagataatagaattatcaatatgaagaactttagtcatttcgatatttatcttgaaaaataa

SEQ ID NO: 34 - DNA, 942 bp, Streptococcus pyogenes
atgataacaacttttgaaacaattttagataaaataaaagctcaccaaactattattatccatcgccatcaaaatcctgaccctgatgctcttggtagtcaggccggcttgaaagaaattattgcacaaaatttcccagacaaaaaggttttgatgactggttttgatgagcctagtttagcttggattagccaaatggatcaggtgactgacaaagactataaagaggctttggtcatcattacagatacagcgaatcgaccaaggattgatgatgagcgctacacactggggaagtgcttaattaagattgatcaccatcccaacgatgatgtgtatggtgacttctattatgtggacacaagcgcttctagcgcaagtgaaatcattgcagactttgcctttagtcagaatcttactctctctgacaaggctgctaagctcttatacaccggtatcgttggtgatacagggcgatttctttatgcctcaaccactagtaaaaccctttccattgctagccaactcagacatttcgagttcgactttgctgcgatttcaaggcaaatggattcgtttcctttgaaaatagcaaagctgcaaagctacgtctttgagcatttaacaattgatgagagtggggctgcttatgtccttgtcagccaagaaaccttaaaacattttgacgtgaccctagcagaaagctctgccattgtctgtgctcctggtaaaattgataacgttcaagcttgggctatttttgttgagttaactgacggcaactaccgtgtgcgtatgcgcagtaaagaaaagattattaatggcattgctaagcgtcacggtggaggggggcatccccttgctagcggagccaactcagctaatttagaagaaaatcaagctattttccgagaactcatcgctgtttgccaagagatttag

SEQ ID NO: 35 - DNA, 1953 bp, Streptococcus pyogenes
atgattgaagaaaataaacattttgaaaaaaaaatgcaagaatacgatgccagtcaaattcaggttctagaagggctggaggctgtccgcatgcgtccagggatgtatattggctcgacagctaaagagggtttgcatcatttagtctgggaaattgttgacaactcaattgacgaagcattagcaggttttgcctctcatattaaagtctttattgaagcagataattccattacagtagtagatgatggccgtggaattccagttgatatccaagccaagacaggacgtcccgccgttgaaacagtttttacagtcttacacgcaggtggtaaatttggtggaggcggctataaggtttctggaggattacatggtgtagggtcatctgttgttaatgctttatcaacacaattagatgtacgtgtttataaaaacggccaaattcattaccaagaatttaaacgcggggctgttgtagcagatcttgaggtcattggaaccactgatgtgactggcacgaccgtacactttacacccgatccagaaatttttaccgaaacgactcagtttgattacagtgttttagcaaaacgtattcaagagttagcctttttgaatcgtggtttaaaaatttccattacagataagcgctcaggtatggaacaagaagaacatttcctttatgaaggtggaattggttcttatgttgaatttttaaatgataaaaaagatgttatctttgaaacgcccatctatacagatggtgaattagaaggtattgcagttgaagtagccatgcaatacacgactagctatcaagaaacagtcatgagttttgctaataatattcatactcatgaaggtggaacgcatgaacaaggctttagagcggctcttactcgggtcatcaatgactacgctaagaaaaataaaattcttaaagaaaatgaggacaatttgacaggagaagatgttcgtgaaggtttgacggcggtaatttctgttaagcatccaaatcctcaatttgaaggtcaaaccaaaacaaaattgggcaactcagaagtggttaagatcactaatcgtctctttagtgaggcctttcaacgttttcttttggaaaacccacaagttgctcgtaagattgtggaaaaagggattttggcttctaaagctagaattgcagctaagcgagcccgcgaagtcacccgcaaaaaatcaggcttagaaatttcaaacttacctggaaaattagcagactgttcgtcaaatgacgctaaccaaaacgaacttttcatcgtcgaaggagattcagcgggtgggtcggccaaatcaggtcgtaaccgagagtttcaagctatcttgcctattcgcggtaaaattttgaacgtggaaaaagcaactatggataagattcttgccaacgaagaaattagaagtctctttaccgctatgggtacaggttttggtgcagattttgacgtgtcaaaagctcgctaccaaaagctggttatcatgaccgatgccgatgtggatggcgctcatattagaaccttacttttaaccttgatttaccgctttatgagacctgttctagaagctggctatgtttacatcgcccagccacctatttatggtgttaaggtcggtagtgagattaaagagtatattcagccaggtattgatcaagaagaccaattaaaaacagctcttgaaaaatatagtattggtcgttcaaaaccaactgttcaacgttataaaggtcttggggaaatggatgaccatcaactttgggaaactactatggatcctgaaaatcgtttgatggcgcgtgtgacagttgatgatgccgcagaagcagataaagtatttgatatgttaatgggagatcgtgttgaaccaagacgtgatttcattgaggaaaatgcggtttatagtacactggatatttag

SEQ ID NO: 36 - DNA, 6138 bp, Streptococcus pyogenes
atgcgtaaggtcaaaaaagtctttgttagttcatgtatgcttttaacagtgggcctcggagttgccgtacctactggattcagccaatctaatggcgtgatggttgtaaaggctgcggaagtgccggcgacagatttatcacgtcaggcgtctgattcggagagggtagatgaatcgtctttattgcagaaagaaaacttatcagtagattcatttaaattagaaaatttaaatggatgggaagctgaaaatgatacagcaggtaatttggggaaatttaaagatccagatagttcgggctatcaaaatattttgacatcatctggaaagaatatcagtgtagctgttgctcccaaaggttcaggtaaaatgaacattaaagtaactaaaagatcaaattttcagggtggatattatgtaggtggtcttagaactcaaactccggtattgaagttaaatgatgtttatcgatattcttttacaactaaaaaattatcaggaaattcttcagagttcaaaacgagagttaagcccgttgaatctaataataaactagggaaagagcttgttattagggtggataataaaaatgtatctactaagcatgattggcttccagacatctctgatggaactcatactgtggacttcactggtcttgataaaaaattatctgttgctttcagattttctccaagacaaacttcgaatgttgtttacgaattttctaacataaatataaaaaacattagtcctgcatcagtgccggctattccttcgaaagttttagagggaaccagcgtcttgtcgggtactgcaatatcttctggagatacattagaaaaaagaaaatcgtttgatggcgatatcctaagagtttataaagatagcaaaatcattgctagaacagtaataaaaggcaataagtgggatgttaaactttcaaagcctcttattgcaggtgaaaaattagattttgagattttgcatccgagatctcaaaacgttagtaaaaaaatttcaaaacaagtcgaagctaaaccatttgatccagcttcctataaagaaaaagttatagccaaattaaagccggtttatgaagctactagtgaaaaaatcacaaatgatgcttggttggatgaaaatgcgaaggatttgcaaaaacaaaaattagaagaacaatatatttctggaaaagtagcgatatcagaggctggaactaaacaagaagctatagatgcagcatataataaatattcaagtcaaacagatccagactctcttcctagtcagtataaacaaggtaataaagaaaatgaacaagaaaaagggcgtcaagatttaatccagactcgtgatctgacgttgaaagccattcaagaagacaaatggctaacagagcaggagaaaacaattcaaaaagaagaagcattaaaagcttttgaaactggtatagaaagtgttaatcaaacagtatcattagaacagttgaagcaacggttaatagtgtataaagcttctgaaaaagattcagagaaaaaagaatatcctgagtcaattcctaatcagcatattccagggaaagaaaaagaagttaaagctgctaaacaagaagaacttaaaaaattacatgacacaactcttgaaaaaatcaatcaagataaatggttgacgccagaccaacaagctgaacagttaaaacaagcggaagttacttttaaaaaaggccaagaagcaattaaaagtgctcagactttaactcagcttgagacagacttagctgattatgtttctgagaatgaaggtaagggaaattctattcccgataaatacaaatctggcaataaagatgatttggtaaataaggctgaagttaaacttaaggaagctcacgaagctactaaacaagcaattgaaaaagatccatggttgagtccggaacagaaaaaagctcaaaaagaaaaagccaaagcaagactagatgagggcttgaaagctcttaaagctgcagatagtttagagattcttaaagtgacagaagaagctttcgttgataaagaaaaaaatccagattcaattccaaatcaacataaagctggaactgctgatcaagctagaaaacaagctttagatagtttagataaggaggttcaaaaagagttagagtcaattgataacgataatactctaacaactgatgagaaagcagctgctaagaaaaaagtcaatgacgcttatgatgtagctaagcaaacagctatggaagccaattcttatgaagatttgactactattaaagatgagttcttatctaatttacctcataaacaaggaacgccgcttaaagatcaacaatctgatgctattgcagaattagagaagaagcagcaagaaattgaaaaagctattgagggtgataaaacattaccaagagacgaaaaagagaaacaaattgctgactctaaggaacgcttaaaatctgacacgcaaaaagttaaagatgctaaaaatgctgatgctattaaaaaagcatttgaagaagggaaagtgaatattcctcaagcacatatcccaggtgatttgaacaaggataaagaaaaacttcttgcagaattgaagcaaaaagcagatgatactgaaaaagctattgatgttgataaaactctgacagaagatgagaaaaaagagcaaaaagtcaaaacaaaagctgaacttgaaaaagctaaaactgatgttaaaaatactcagacacgtgaagaactagataaaaaagttccagaacttaagaaagctattgaagacactcacgttaaaggtaatcttgaaggtgttaagaataaggctattgaagatcttaaaaaagctcatactgaaacagttgctaaaataaatggtgatgatacccttgacaaagctactaaagaagctcaagtgaaagaagctgacaaagctttggcagcaggtaaagatgcgatcactaaagcagatgatgctgataaagtaagtacagctgttacagagcacacaccaaaaattaaagcagcacataaaactggtgaccttaaaaaagctcaagtagatgctaacacagctcttgacaaagcagctgaaaaagaacgtggagaaatcaataaagatgctacactaacgacagaagataaagcaaaacaactgaaagaagttgagacagctcttactaaagctaaagataacgtgaaagctgctaagacagcagacgctatcaatgacgcacgtgataaaggcgtagcaacaattgatgccgtccataaagcaggtcaagacttaggtgctcgtaagtcaggtcaagtcgctaaacttgaagaagcagctaaagcaacgaaagacaagatttcagctgatccaactttgacaagcaaagaaaaagaagagcaatctaaagctgttgacgctgaacttaagaaagcgatagaagctgttaacgcagctgacacagctgacaaggttgacgatgctcttggtgaaggtgttacagacatcaagaaccaacacaagtcaggtgactctatcgacgctcgtcgtgaggctcatggtaaggaacttgatagagtcgctcaagaaactaaaggtgcgattgaaaaagaccctactttgacgactgaagaaaaagctaaacaagttaaagacgtagatgccgctaaagaaagaggcatggctaagcttaatgaagctaaagatgctgatgctttagacaaagcttacggtgaaggtgttacagacatcaagaaccaacacaagtcaggtgaccctgtcgacgctcgtcgtggattacacaacaagtcaatcgacgaagtggcgcaagcaactaaggacgctatcacagcagatacgactttgactgaagctgaaaaagaaacacaacgtggcaatgttgataaagaagcaactaaagctaaagaagaacttgctaaggctaaagatgctgatgctttagacaaagcgtacggtgacggtgtaaccagcatcaagaaccaacacaagtcaggtaaaggtcttgacgttcgtaaagatgagcacaagaaagctcttgaagctgttgctaaacgtgtcactgctgaaattgaggctgatccaaccttaacaccagaagtgagagaacaacaaaaagcagaggttcaaaaagagcttgaacttgcgactgataagattgctgaagctaaagatgcagatgaagcagacaaagcttacggtgacggtgtcacagcgatcgaaaatgcccacgttattggtaaaggtatcgaagctcgtaaagaccttgctaagaaagaccttgctgaagctgctgctaagacaaaagctctcattattgaagacaaaacgcttactgatgatcaacgtaaagaacagttattaggtgttgatacagagtatgctaaaggtatcgagaatattgatgcagctaaggatgctgcaggtgttgataaagcatatagtgacggtgttcgtgacatcctggcacagtacaaagaaggtcaaaaccttaatgatcgtcgtaatgctgccaaagaatttcttcttaaagaagcagacaaagtgacgaaactaatcaatgatgatccaaccttgactcatgaccaaaaagttgatcaaatcaacaaagttgaacaagctaagttagacgcaatcaagtctgttgatgatgctcaaacagctgatgctatcaatgatgctcttggtaagggtattgaaaacatcaacaaccaataccaacatggcgatggcgttgatgttcgtaaagcgactgccaaaggcgatcttgaaaaagaagctgctaaagtgaaagctcttattgctaaggatccgaccttaactcaagctgataaagacaaacaaacagcagcggttgacgcagctaagaatacagcaattgcagcggttgataaagcgacaacaactgaaggcattaaccaagaacttggtaaaggcatcacagctatcaataaagcttaccgtccaggtgaaggtgttaaagcacgtaaagaagccgctaaagctgatcttgaaaaagaagctgctaaagtgaaagctcttattactaacgacccaaccttaacaaaagctgataaagctaaacaaacagaagctgttgctaaagcccttaaagctgctatcgcagcggttgataaagcgacaacagctgaaggcattaaccaagaacttggtaaaggcatcacagctatcaataaagcttaccgtccaggtgaaggtgttaaagcacgtaaagaagccgctaaggctgatcttgaaagagaagctgctaaggttcgtgaagctatcgctaacgacccaaccttaacaaaagctgataaagctaaacaaacagaagctgttgctaaagctcttaaagctgctatcgcagcggttgataaagcgacaacagctgaaggcattaaccaagaacttggtaaaggcatcacagctatcaacaaagcttaccgtccaggtgaaggtgttgaagcacataaagaagctgctaaagctaatcttgaaaaagtagctaaagaaactaaagctcttatttcaggagaccgttacttgagcgaaactgaaaaagcagtccaaaaacaagctgttgagcaagctcttgcgaaagcacttggtcaagttgaggctgctaagacagttgaagctgttaagttggcagaaaaccttggtactgtagctatccgttcagcatatgttgctggtttagctaaagatactgatcaagcaacagctgctcttaacgaagcgaaacaagctgctattgaagctcttaaacaagctgcggcagaaacacttgctaagattacaactgatgctaaattgactgaagctcaaaaagctgaacaatcagaaaatgtatcattagcgcttaagacggctattgcgactgttcgttcagcacaatctattgcgtctgtgaaagaagcaaaagataaaggtattactgctatccgtgcagcctatgtgcctaataaggcagtcgcaaaatcatcgtcagcgaaccatcttccaaaatcaggtgatgcaaactcaattgttcttgttggcttaggagttatgtctcttcttttaggtatggtgctttatagcaagaaaaaagaaagtaaagactaa

SEQ ID NO: 37 - DNA, 2733 bp, Streptococcus pyogenes
atgattaacaagaaatgtataatacctgtttcattgttgacactagctattacgcttactagtgttgaagaagttacttcacgccaaaatttgacttatgccaatgaaatcgtaacacaaaggccaaagagagaatctgttattagtgataaatcgaattttcccgtcatatcaccttacctagcaagtgtggattttggtgagagaaaaacacctttgccaacacctgataaaggagtaaaagtaactactgaacagtctattgctcaagtaagaaaggggcctgaagaaagaccctatactgttactggcaagattacgagtgtgatcaatggctggggaggctatggcttttatattcaagatagtgaaggtattggactttatgtttatcctcaaaaagatttaggatacagtaagggagatattgttcaattaacaggtacacttactcgctttaaaggtgatttacaactccaacaggtgactgcacacaaaaagttagagttatcttttccgacttctgttaaagaagcagtaatatcagaattagaaacaacaacaccctcaacattagttaagttatctcacgtgacagttggagaattatcaactgatcaatataacaacacatctttccttgtaagggatgatagtggtaaaagtatagttgttcatatagatcatcgtacaggggttaaaggggctgatgttgttactaaaataagtcagggtgatttgattaacctcacagccatattgtctattgttgatggtcaattacaattaagaccgttttctcttgaacaattggaagtggttaaaaaggtcacaagctcaaatagtgatgcttcatctcgtaatattgtgaaaataggcgagattcaaggagctagtcatacgtcgccacttctcaaaaaagcggtcaccgtagaacaggttgttgtcacttatttagacgattccactcatttttatgttcaagatcttaatggtgatggtgatttagcgacttcagatggtattcgtgtttttgctaaaaacgctaaggttcaagtcggcgatgttttgaccatttcaggtgaagtggaagaattctttggtcgtggttatgaggaacgtaagcagactgaccttaccatcacccaaattgtggctaaagcagtgaccaaaacagggacagctcaagttccatcaccgcttgttttagggaaagatcgtatcgcgccagccaatattattgataatgatggcttgcgtgtgtttgatccagaagaagacgctattgattattgggaatcaatggaaggcatgttagtggcggttgatgatgctaaaatccttggtccaatgaaaaataaagaaatttatgtcttacctggctctagtacaagaccgttaaataattcaggtggagtattacttccagctaattcttataacacagatgtgattcctgttcttttcaaaaaaggcaaacaaattattaaagcaggagactcttacaaaggaagattagctgggccagtatcttatagctatggtaattacaaggtctttgttgatgacagcaaaaacatgccaagtttaatggatggtcatctaaaacctgaaaaaacaaacttgcaaaaagaccttagcaagttaagcattgcttcttacaatattgaaaacttctcagccaatccttcttcaactaaagatgagaaggtcaaacggattgccgaatcctttattcatgatctgaatgctccagacattattggattaattgaagtccaagataataatgggccgactgatgatgggacaacggatgcgacacaaagcgcgcaacgcctcattgatgctattaaaaaactaggtggcccaacttatcgttatgttgatattgctccagaaaataatgttgacggaggtcaaccaggtggtaatattcgaacaggattcctttatcaaccagagcgcgtcagcctttctgataagccaaaaggcggtgctcgtgatgctctaacttgggttaatggagaattaaaccttagtgttggtcgaattgatccaactaacgccgcttggaaagatgttcgtaaatcactagcagcagaatttatcttccaaggtcgtaaagtcgttgttgttgcaaatcatttgaactctaagcgtggggataatgctctttatggttgtgtgcaaccagtcacttttaaatctgagcaaagacgtcacgtcttggctaatatgctagcacaatttgcgaaagaaggggcaaaacaccaagctaatattgtgatgctaggtgactttaatgattttgaattcacaaagacgattcaattaatcgaagaaggtgacatggttaacttggtgagccgacatgatatttcagatcggtattcttattttcaccaaggcaataatcagacccttgataatatattagtttcacgccatttacttgatcactacgaatttgacatggttcatgtgaattccccatttatggaagctcacggacgcgcatcagatcatgatccattgttacttcaattatcattttccaaagaaaatgataaggcagagtcttctaaacaaagtgtaaaagctaaaaaaacttcaaaaggaaaactgttgccaaaaacaggagatagtcttgtttatgtgataacgctactaggaacggctagtttattagtgcctattttattattgactaaaggcaaaaaggaatcatag

SEQ ID NO: 38 - DNA, 3633 bp, Streptococcus pyogenes
gtgatttcttttgccccatttttaagccccgaagctattaaacatttgcaagaaaacgaaaggtgcagagatcagtctcaaaaacgcacagctcaacaaattgaagcaatttatactagtggccaaaatatacttgtatcagcttctgctggttcaggaaaaacctttgtaatggtcgaacgcatacttgataaaattttgagaggtgtttcaattgatcggctttttatctcaacctttactgttaaagcagctacagaactgcgtgagcggattgaaaacaaattatactcacaaattgctcaaactacagattttcaaatgaaagtttatttaacagaacaattgcaatctctttgtcaagctgatattggtactatggatgcttttgcacagaaagtagtaagtcgctatggttatagcattggcatttcatcccaatttcgtatcatgcaggataaagcagaacaagatgttttaaagcaagaggtgtttagcaaactctttaatgagtttatgaatcaaaaagaggcaccggtgtttagggctcttgtgaaaaatttttctggtaactgtaaagacacttcagcttttagagagttagtttatacttgttattcttttagccaatcgacagaaaacccaaaaatatggttgcaagaaaattttctaagcgctgctaaaacttaccaaagacttgaagatatcccggatcatgatattgaactcttacttttggcaatgcaagacactgcaaatcagctaagagatgtgactgatatggaagattatgggcagctgactaaggcaggtagccgatctgctaaatacactaaacacttaacgatcatagaaaagttgtctgattgggtgcgtgattttaaatgtttgtatggaaaagccggattggatcggttgatcagagatgtgacaggccttataccatctgggaatgatgttacagtctcgaaggtaaaataccctgtttttaagaccttgcatcaaaaattaaaacaatttaggcatttagaaacaattttaatgtatcagaaagactgtttttccttattggaacagttacaagattttgtgcttgcgttttcagaagcttatttagctgtcaaaatacaagaaagtgcttttgaattttcagatattgcacactttgcaatcaaaattttagaggaaaatacggatattcgccaatcctatcagcaacactatcatgaggtgatggttgatgaatatcaagataacaatcatatgcaagagcgactcctgaccttactatcgaacggtcataatcgctttatggtaggagatatcaaacaatcgatctatcgatttcggcaagccgatcctcagatttttaatcaaaagtttagagactatcaaaaaaaacctgagcaggggaaagtgattttactcaaagaaaactttcgtagccaatcagaggtgttaaatgtcagcaatgctgtttttagtcacttaatggacgaatcagtaggagacgtcttatacgatgagcaacatcagttaatagcaggtagtcatgctcaaacagtcccctatctagaccgtcgtgctcagttattgctatataatagcgataaagatgatggcaacgccccttcagatagtgagggtatttcatttagtgaggttacaattgttgccaaagaaattattaagcttcacaatgataagggtgtcccttttgaagacattacgttactcgtttcttcaagaacaagaaatgatatcatttctcatacattcaatcaatatggtattcctatagcaacagatggtgggcagcaaaactatcttaaatctgttgaagtgatggttatgttagatacattacgcaccattaataacccaagaaatgattatgcccttgtggctttactgcgctcaccgatgtttgcctttgatgaggatgatttagcaagaatagcacttcaaaaagacaatgagctagataaagattgcctatatgacaagatacaaagggctgtgattggaagaggtgctcatcctgaattgattcacgataccttgcttggcaagttaaatgtttttttaaagacgttgaaaagctggcgtcgatacgctaagctagggtcgttgtatgacttgatttggaaaatttttaatgatcgtttttattttgattttgtagctagtcaagcaaaagcagaacaagcacaagctaatctatacgcattagctctacgtgctaatcagtttgaaaaatcgggctataaagggctataccgttttattaaaatgattgataaggtacttgagacgcaaaatgacttagctgatgtggaagtggctactcctaaacaagctgttaatttaatgaccattcacaagtctaaaggtttacaatttccgtatgtatttatccttaattgtgacaagcgcttctcaatgacagatattcataaatcatttattctgaatcggcagcacggtatcggtatcaagtaccttgcagatatcaaaggtttacttggtgaaacaacactcaattctgttaaagtaagcatggaaaccttaccttatcaattgaacaaacaagagttgcgcttagcaactttatcagaagaaatgcgcttactgtatgttgctatgacacgagctgaaaaaaaagtttattttattggtaaagctagtaagagcaaaagtcaagaaatcacagatcctaaaaagttaggcaaacttttgccgctggctttacgagaacagttattgacattccaagattggctattagcaatagcagatatattttcaactgaagatctttattttgatgttcgctttattgaagatagtgatttgacacaagagtcagtcggacgacttcaaacaccacagttattaaatccagatgatcttaaagataatcgtcaatcagaaacaattgcacgggctttagatatgttagaagcagtgtctcaattgaatgccaattatgaagcagctattcatttgccaacagttcgaacgcctagccaacttaaggcaacttacgagcctttattagaacccattggtgtagatattatagagaaatcttctcgatcgctatctgattttactttgccacatttttcaaaaaaagcaaaagttgaagcaagtcatattggatcagctcttcatcagttgatgcaggtgctccctttgtcaaaaccgataaatcaacaaacgcttttagacgctttaagaggaattgatagtaacgaagaggtaaaaacagctcttgatctcaaaaaaatagagtcgttcttttgtgatacaagcctaggccaattttttcagacttaccaaaaacacttgtatcgagaagcgccatttgctattttaaaacttgaccctatcagtcaagaagagtatgtcctacgtggtattatagatgcctactttttgtttgatgatcatattgtattagtggactataaaacagataaatacaagcagcccattgagttaaaaaagcgttaccaacaacagttggagttatatgcagaagctctcactcaaacgtataaacttcctgtgactaagcgctatcttgttttaatgggaggtggaaagccagaaattgtcgaagtttaa

SEQ ID NO: 39 - DNA, 762 bp, Streptococcus pyogenes
atggtaaaaacggattttaaattacgctatcaagggagcgcaattggctatctatggtctatcttaaaaccgcttatgatgtttacgattatgtacttggtatttattcgttttcttcgcctgggtggaaatgtacctcattttccagtagcgcttttattggcaaatgtcatctggtcttttttttcagaagcaactagcatgggaatggtatctattgtatctcggggagacttgttgcgaaaattgaacttttctaagcacatcattgttttttcggcagtgttaggagctttaattaattttcttattaatttggttgttgttttaatttttgcgttgataaatggtgtgactatatcagggtatgcttatctctctctttttctttttatagaattagttgttttagtgcttggaattgcattgttattgtcgaatgtctttgtttattatcgtgacttagctcaagtctgggaagtactattacaagcaggtatgtatgccactccaatcatttatccgatcacttttgttttagatagccaccctttggcggcaaagttgttgatgctaaatccagtagcacaaatgattcaagattttcgttatttattgattgacagggccaacgtaacgatttggcagatgtcaaccaattggttttacattgttattccatatttagtaccatttgttatattatttattggcatctttgtctttaagaaaaatgccgatagatttgcggagattatttaa

SEQ ID NO: 40 - DNA, 1734 bp, Streptococcus pyogenes
atgacatttttatctgatttgatatcattaatgacaaaaatcagattatcttgggtaataaaggcgggtatttttcaattattatttgtaacgattgctaatattgtcttatcagaatttttctattttatattagacgttactggtcaatatcatttagataaagacaatgttgtgacttttttaaaaaatcctatagcacttgctttattaggtgcctatttatttttattagctgcttttattcaccttgagttttttgctctatatcgaattattgcggatcaagaaattagtttctatctttttagaaaacagttttcttattacctaagggggctttggaaaacattttctggttaccaattattactttttttgctttatatcctattgactattccagtcttacatattggtttatcttctgtgattactcaaaagctttatcttccagaatttattgttggggaattatcaaagataactagcacaaagtacttgctttatggcagtcttattcttgtgttttaccttaacctaagattagtatattttttaccattgatagcaatcaaccatcgtacggttgctcaagcatggagagagagttggcaaaagactaaaaagaaacatgtattgttatggatgaaactttttgcaatcaatggtcttacgattgtagtcttatcgctagctatttccatgattcttatttttgttgatatgtttaatcctaaggggaataatattattgttcagctgggagctttgacctttacatgggaactcattttttttactactattttttttaaactctgttcagcaatgattttaaaagaggcaattgaaccacaaaagcaatatgatgagccaagaagaagtaataaggcatatgttgtaatctttatcgtggttacagtaggttttgcttatcaatctcttgaacgtttaactttttttgacacatctcactctaagacagttatcgcgcatagaggacttgtatcagcaggtgtagaaaattctctggaagcccttgaaggtgctaagaaagcaggaagtgattatgtagaactggatctaatcttgactaaggataatcactttgtggtgtctcatgataatcgattgaagcgtttagctggagtaaataagacgattcgcaacttaaccttaaaagaagttgaacatctaacgagtcatcaaggacatttttcagggcgttttgtttcttttgacactttttatcaaaaggctaagaagttgaatatgccattacttattgaactcaagccaattggtacagaacctggaaattatgtcgatttgtttttagaaacttatcatcgacttggtataagcaaagataataaagtcatgtctttagatttagaagtaatagaagctatcaagaaaaaaaatccatcaattacgactggttatatcataccaattcaatttggattttttggagatgaatttgttgatttctatgtcattgaagacttttcttatcggtcttatttgtcgtcccaagctttttggaataataaagaaatttacgtttggactattaatgatcccaagcgcatagagcattatctcctaaagcctattcagggaattattacagaccaaccagctttaactaatcaattgattaaagacttaaaacaagataattcttattttagtcgattagtcagaattattagtagtctttattaa

SEQ ID NO: 41 - DNA, 3027 bp, Streptococcus pyogenes
atgaagaaacatcttaaaacagttgccttgaccctcactacagtatcggtagtcacccacaatcaggaagtttttagtttagtcaaagagccaattcttaaacaaactcaagcttcttcatcgatttctggcgctgactacgcagaaagtagcggtaaaagcaagttaaagattaatgaaacttctggccctgttgatgatacagtcactgacttattttcggataaacgtactactcctgaaaaaataaaagataatcttgctaaaggtccgagagaacaagagttaaaggcagtaacagagaatacagaatcagaaaagcagatcacttctggatctcaactagaacaatcaaaagagtctctttctttaaataaaacagtgccatcaacgtctaattgggagatttgtgattttattactaaggggaatacccttgttggtctttcaaaatcaggtgttgaaaagttatctcaaactgatcatctcgtattgcctagtcaagcagcagatggaactcaattgatacaagtagctagttttgcttttactccagataaaaagacggcaattgcagaatataccagtagggctggagaaaatggggaaataagccaactagatgtggatggaaaagaaattattaacgaaggtgaggtttttaattcttatctactaaagaaggtaacaatcccaactggttataaacatattggtcaagatgcttttgtggacaataagaatattgctgaggttaatcttcctgaaagcctcgagactatttctgactatgcttttgctcacctagctttgaaacagatcgatttgccagataatttaaaagcgattggagaattagctttttttgataatcaaattacaggtaaactttctttgccacgtcagttaatgcgattagcagaacgtgcttttaaatcaaaccatatcaaaacaattgagtttagaggaaatagtctaaaagtgataggggaagctagttttcaagataatgatctgagtcaactaatgctacctgacggtcttgaaaaaatagaatcagaagcttttacaggaaatccaggagatgatcactacaataaccgtgttgttttgtggacaaaatctggaaaaaatccttctggtcttgctactgaaaatacctatgttaatcctgataagtcactatggcaggaaagtcctgagattgattatactaaatggttagaggaagattttacctatcaaaaaaatagtgttacaggtttttcaaataaaggcttacaaaaagtaaaacgtaataaaaacttagaaattccaaaacagcacaatggtgttactattactgaaattggtgataatgcttttcgcaatgttgattttcaaaataaaactttacgtaaatatgatttggaagaagtaaagcttccctcaactattcggaaaataggtgcttttgcttttcaatctaataacttgaaatcttttgaagcaagtgacgatttagaagagattaaagagggagcctttatgaataatcgtattgaaaccttggaattaaaagataaattagttactattggtgatgcggctttccatattaatcatatttatgccattgttcttccagaatctgtacaagaaatagggcgttcagcatttcggcaaaatggtgcaaataatcttatttttatgggaagtaaggttaagaccttaggtgagatggcatttttatcaaatagacttgaacatctggatctttctgagcaaaaacagttaacagagattcctgttcaagccttttcagacaatgccttgaaagaagtattattaccagcatcactgaaaacgattcgagaagaagccttcaaaaagaatcatttaaaacaactggaagtggcatctgccttgtcccatattgcttttaatgctttagatgataatgatggtgatgaacaatttgataataaagtggttgttaaaacgcatcataattcctacgcactagcagatggtgagcattttatcgttgatccagataagttatcttctacaatagtagaccttgaaaagattttaaaactaatcgaaggtttagattattctacattacgtcagactactcaaactcagtttagagacatgactactgcaggtaaagcgttgttgtcaaaatctaacctccgacaaggagaaaaacaaaaattccttcaagaagcacaatttttccttggccgcgttgatttggataaagccatagctaaagctgagaaggctttagtgaccaagaaggcaacaaagaatggtcagttgcttgaaagaagtattaacaaagcggtattagcttataataatagcgctattaaaaaagctaatgttaagcgcttggaaaaagagttagacttgctaacaggattagttgagggaaaaggaccattagcgcaagctacaatggtacaaggagtttatttattaaagacgcctttgccattgccagaatattatatcggattgaacgtttattttgacaagtctggaaaattgatttatgcacttgatatgagtgatactattggcgagggacaaaaagacgcttatggtaatcctatattaaatgttgacgaggataatgaaggttatcatgccttggcagttgccactttagctgattatgaggggctcgacatcaaaacaattttaaatagtaagcttagtcaattaacatctattcgtcaggtaccgactgcagcctatcatagagccggtattttccaagctatccaaaatgcagcggcagaagcagagcagttattgcctaaaccaggtacgcactctgagaagtcaagctcaagtgaatctgctaactctaaagatagaggattgcaatcaaacccaaaaacgaatagaggacgacactctgcaatattgcctaggacagggtcaaaaggcagctttgtctatggaatcttaggttacactagcgttgctttactgtcactaataactgctataaaaaagaaaaaatattaa

SEQ ID NO: 42 - DNA, 2013 bp, Streptococcus pyogenes
atgaaaaaatattttattttaaaaagtagtgtattgagtatcctgactagttttactctattagttacagatgttcaagcagatcaagttgatgtgcaattccttggcgtcaatgattttcacggcgctcttgataataccggaacagcttacacaccaagtggtaaaataccaaatgctgggacggctgctcaattaggtgcttatatggatgacgctgagatagacttcaagcaagcaaatcaagacggaacaagtatacgtgttcaagctggagatatggtcggagccagtcctgctaactctgcacttttacaagatgagcctactgtcaaagtctttaacaaaatgaaatttgaatatggcactcttggtaatcatgaatttgacgaaggactagatgaatttaaccgtatcatgacaggtcaagcgcctgatcctgaatcaacaattaatgatatcaccaaacaatatgagcacgaagcttcgcatcaaaccatcgtcattgctaatgttattgataaaaaaaccaaggatatcccctatggttggaaaccttatgctataaaagacatagccattaatgacaaaatcgttaagattggcttcattggtgttgtgactacagagattccaaatctcgttttaaagcaaaactatgaacactatcaatttttagatgtagctgaaaccattgccaaatatgctaaagaactacaagaacaacatgttcatgctattgtggttttagctcatgttcctgcaacaagtaaagatggtgttgttgatcatgaaatggctacggttatggaaaaagtgaaccaaatctatcccgaacatagcattgatattatttttgcaggacataatcatcaatacactaatggaactatcggtaaaacacgtatcgttcaagccctctctcaaggaaaagcttatgcagatgtccgtggtacgctagatactgataccaatgattttattaaaactccatcagcaaatgttgttgctgtagcaccaggtatcaaaacagaaaattcagatatcaaagctataataaatcatgctaatgatattgttaaaacagttactgaacgaaaaatcggaactgcaactaattcttcaactatttctaaaacagaaaatattgataaagaatctcctgtcggtaacttagcaacaacggctcagcttactattgctaagaaaacttttccaactgttgactttgctatgaccaataatggtggtattcgaagtgacctagttgtcaaaaatgaccggaccatcacctggggagctgcacaggctgtacaaccatttggtaatatccttcaagtcattcaaatgactggtcaacacatttacgatgtcctaaatcagcaatacgatgaaaaccagacctattttcttcaaatgtcaggtttaacatacacttatacagataatgatcctaagaactctgatacccccttcaagatagttaaggtttataaagacaatggtgaagaaattaacttaacaactacttacaccgttgttgtcaacgactttctttatggtggtggtgatggcttttcagcatttaaaaaagctaaattaatcggagctattaacacagatactgaagctttcatcacatatatcacaaatttagaagcatcaggtaaaactgttaatgctactataaaaggggttaaaaattatgtaacttcaaaccttgaaagttcgacaaaagttaatagtgctggtaaacacagtatcattagtaaggtttttagaaatcgtgatggcaatacagtgtctagtgaagtcatttcagaccttttgacttctactgaaaacactaataacagccttggcaaaaaagaaacaacaacaaacaaaaatactatctctagttccactcttccaataacaggggacaattataaaatgtctcctattatgacaatccttgccttgataagcttaggtggactaaacgcttttattaaaaaaaggaaatcctag

SEQ ID NO: 43 - DNA, 789 bp, Streptococcus pyogenes
atgactaataatcaaacactagacatccttttggatgtctatgcttataatcacgcctttagaattgctaaagccttgccaaatatccctaaaactgccctctatttactagagatgttaaaagagcgcagagaattgaaccttgcctttctagcggaacatgcagcagagaatcggaccattgaagaccagtatcactgttcattatggcttaaccaatcgcttgaagatgagcagattgccaattacattttggatttagaagttaaagtaaaaaacggtgctattattgatttcgtcaggtcagtgtcgcctattctttaccgactttttctcagactaatcacgtcagaaattccaaacttcaaggcttatatttttgatacaaagaatgaccaatatgatacctggcattttcaggccatgttggaatctgatcacgaggttttcaaggcttacctgtctcaaaagcagtctcgcaatgtgacgaccaaaagcttagcagacatgttgacgttgacctccttacctcaggaaatcaaggacttggtttttttgttacgacattttgaaaaggctgtccgtaatcctctggctcatttgattaagccttttgatgaagaggaactgcatcgcaccactcatttttcttctcaggcttttttggaaaacattatcaccttggcgactttttctggtgtaatctaccgacgtgagcctttttactttgatgacatgaatgccattattaaaaaggagttgagcctttggagacaatctattgtctga

SEQ ID NO: 44 - DNA, 1290 bp, Streptococcus pyogenes
atgaagacaacatccctgattaaagtagatttgccatcaacaatcggtataggttatggcgctttttggcggtctagaaatttttatcgagtagttaaaggcagccgtggatctaaaaaatctaaaacgactgctttaaattttatcgtcagactgctgaagtacccttgggctaacttattggtcatccgtagatactcaaacactaacaaacaatctacttataccgattttaaatgggcgtgtaatcaattaaaggttacacacctttttaagtttaatgagagtttgccagaaataactgtaaaggcaacgggccaaaagatactgttccgtggacttgatgatgagttaaaaatcacatctattactgtcgatgttggcgctttgtgctgggcttggtttgaagaggcttatcaaattgagaccgaagataagttttcaacagttgtcgaatcaatccgcggtagtttagatgctcctgatttttttaaacagataacagtcacgtttaacccgtggtcagaaagacattggcttaaacgtgtcttttttgatgaagaaactaaacgggctgatacattttctgggactacaacatttagagtaaacgaatggcttgatgatgtcgataaaagacgctacgaagatttgtacaagactaatccaaggcgggctagaatcgtgtgcgatggtgaatggggcgttgctgaaggtcttgtttttgataactttgaagtcgtagattttgatgttgaaaaaacaattcaacgcgttaaagagacctcggccggtatggactttgggtttactcaagaccctacaactcttatatgtgttgcagttgacctcgcaaacaaagagttatggctttacaacgaacattatcaaaaggctatgttaacagatcatattgtcaaaatgataagagataaaaacttgcataggtcttacatcgcaggggatagcgccgaaaaacgcctcattgcagaaataaaaagtaaaggggtgtctggaattgtcccgagtattaaaggtaaagggtcaatcatgcaagggattcaattcatgcaggggtttaagatatatattcacccatcttgcgaacacacaatagaagagtttaatacttacacttttaagcaagacaaagaaggtaattggttaaacgaaccgatagataagaataaccacgttattgatgcgattagatatgcgcttgaaaaataccatatcagaagcaacgagtcaaatcagtttgaagttcttagggctggttttggttactag

SEQ ID NO: 45 - DNA, 534 bp, Streptococcus pyogenes
atggcagaagaaacacaaacagttgaaacggttgaagagcaagtggtaccagaagcaaaacaaccgcaagacgaaaaaaagtacacagatgcagatgtggacgctatcatcgacaaaaagtttgcgaagtggaagtcagaacaagaagcggagaaatcggaagctaaaaaaatggctaagatgaatgaaaaagagaaagcagactacgaaaagcagaagctgttagacgaattgcaagagctaaaaaacgataagacacgcaatgagttaacagcagtagctcgtcaaatgtttgcagaatctgaaatcaacgtcaacgatgacgtacttggtttagttgtgactttggacgcagaacaaacaaaagcaaatgtaacaacgctagcaaacgcatttgctaaagttatcgctgatgaccgcaaggctcttgtacgccagactactccgtcaacaggtggtggattgagcaaacaaaccaattacggtgctaacttggctagtaaggcagcacaacaaagcaccaaacttttttag

SEQ ID NO: 46 - DNA, 711 bp, Streptococcus pyogenes
atgagatataattgtcgctactcacatattgataagaaaatctacagcatgattatatgtttgtcatttcttttatattccaatgttgttcaagcaaattcttataatacaaccaatagacataatctagaatcgctttataagcatgattctaacttgattgaagccgatagtataaaaaattctccagatattgtaacaagccatatgttgaaatatagtgtcaaggataaaaatttgtcagttttttttgagaaagattggatatcacaggaattcaaagataaagaagtagatatttatgctctatctgcacaagaggtttgtgaatgtccagggaaaaggtatgaagcgtttggtggaattacattaactaattcagaaaaaaaagaaattaaagttcctgtaaacgtgtgggataaaagtaaacaacagccgcctatgtttattacagtcaataaaccgaaagtaaccgctcaggaagtggatataaaagttagaaagttattgattaagaaatacgatatctataataaccgggaacaaaaatactctaaaggaactgttaccttagatttaaattcaggtaaagatattgtttttgatttgtattattttggcaatggagactttaatagcatgctaaaaatatattccaataacgagagaatagactcaactcaatttcatgtagatgtgtcaatcagctaa

SEQ ID NO: 47 - DNA, 2418 bp, Streptococcus pyogenes
gtgaatacttatttttgcacacaccataaacaattactactttattcaaacctattccttagctttgctatgatgggccaaggaactgccatttatgccgatacactgacttcaaattcagaacctaataatacttactttcaaacgcaaacgctcactactacagatagcgaaaaaaaggtagtacagccacaacaaaaagactactatactgaattgttagaccaatggaacagtattatcgcaggcaacgatgcttatgataaaaccaatcctgacatggtcacttttcataataaagctgaaaaggatgctcaaaacattattaaaagctatcaagggcctgaccacgaaaatagaacttacctttgggaacatgcaaaggattattccgcttctgctaatatcacgaaaacttaccgcaatattgaaaaaatagcaaaacagatcactaatcctgaatcatgctattatcaagatagtaaagctattgctattgtaaaagacggtatggccttcatgtatgaacacgcttataatctagatcgtgaaaatcatcaaacaactggaaaagaaaacaaagaaaattggtgggtttatgaaattggaactcctcgtgctattaataataccttatccttgatgtatccttattttactcaagaagaaattcttaaatacacagctccaatcgaaaaatttgtgcctgaccctactcgttttagggttcgcgctgccaatttttcaccttttgaagccaatagcggaaatttaattgatatggggcgtgttaaactcatttccggtattcttcgtaaagatgatctcgaaattagtgatacaatcaaagcaattgagaaagttttcacgctagttgatgaaggaaatggtttttaccaagacggttctttaattgatcacgtggttactaacgctcaaagtccactttataaaaaaggcattgcttacactggagcttacggtaatgtgcttatagatggcttatcgcaattaattcctattattcaaaaaacaaagtctcctataaaagcggataaaatggctactatctatcattggattaaccattcttttttccctatcatcgttcgtggagaaatgatggatatgactcgagggcgttctatcagtcgttttaatgcccaatctcatgttgctggcattgaagcacttcgtgctattttacgtattgctgacatgtctgaagagcctcaccgtttggcacttaaaacacgtataaaaacactcgtcacacaagggaatgctttttacaatgtctatgataatttgaaaacctatcacgatatcaaacttatgaaagaactactaagtgatacttctgttccagtccaaaaacttgatagttacgtagctagtttcaatagtatggataaattggcactatataataataaacacgattttgcttttggcctatcaatgttttcgaatcgaactcaaaattatgaagctatgaataatgaaaatcttcatggctggtttacttctgatggaatgttttacctatacaataacgatttaggacactacagtgaaaactattgggcaacggtaaatccctaccgcttacctggaaccacagaaactgagcaaaaaccactagagggaactcctgagaatattaaaacgaactatcaacaagttggcatgactggtctctctgatgacgcttttgttgcaagtaaaaaacttaataacacaagtgctctagctgctatgaccttcactaattggaataaaagcctcaccctcaataaagggtggtttatcttaggaaacaaaataatctttgttggtagcaatatcaaaaaccaatcatctcacaaggcgtatacaactattgaacaacgaaaagaaaatcaaaagtacccttactgttcttatgttaacaatcaacccgttgacttgaataatcagctagttgattttacaaacactaaaagtattttccttgaaagtgatgatcccgctcaaaatattggttactacttcttcaagccaacaacacttagcataagtaaggcacttcaaacagggaaatggcaaaacataaaagctgatgacaaatcaccagaagccatcaaagaagtttcaaatacctttatcactatcatgcaaaaccatactcaagatggcgatcgttatgcctatatgatgcttccaaatatgactcgtcaagaatttgaaacctatattagcaagcttgatatcgacttattagaaaacaatgacaaactggccgctgtctacgatcatgatagtcaacagatgcacgtcattcactatggaaaaaaagcaacgatgttttcaaatcataatctttctcatcaaggcttttatagttttcctcatcctgtcaggcaaaatcaacaataa

SEQ ID NO: 48 - DNA, 882 bp, Streptococcus pyogenes
ttgctgacctttggaggtgcaagtgcggttaaggcggaagaaaatgaaaaagtaagagagcaagaaaagctcatacagcaactttctgaaaagctagtggaaattaatgacttacaaactttaaatggtgataaagagagtatacagtctctcgtagattatctgactcgaagaggaaaacttgaagaagaatggatggaatatttgaattctggtattcaacgcaaactttttgttggtccaaaaggacctgcaggtgaaaaaggagaacaaggtcctactggaaaacaaggcgagcgtggtgagaccggccctgcaggtccacgtggtgacaagggcgaaactggtgacaaaggagcccagggtccagtaggtcccgctggcaaggacggccaaaacggtaaagatggtcttccaggtaaagacggcaaggacggccaaaacggtaaagatggtcttccaggtaaagacggcaaggacggccaagacggtaaagatggcctcccaggtaaagacggtaaggatggccaaaatggcaaagatggtcttccaggtaaagacggtcaaccaggtaaaccagctcctaaaacaccagaggtccctcaaaacccagatactgcaccacatactccaaaaacccctcggatccctggtcaatcaaaagacgtgacacctgctcctcaaaacccttctaatagaggtctaaacaaaccacaaacacaaggtggtaatcagctcgcaaaaacaccggcagctcacgacacacacagacaattgccagcaacaggcgaaacaaccaatccattctttacagcagctgctgtagctatcatgacgacagctggagttgtagctgttgcaaaacgtcaagaaaacaactaa

SEQ ID NO: 49 - DNA, 972 bp, Streptococcus pyogenes
atgtatatattctcatcgtcaaaaaaagatagtgctaaagaattagttatcttgactcctaatagccaaactattttaacagggactattccagcctttgaggaaaagtatggggttaaagtaagattaatccaaggtgggacgggccaacttattgatcaattaggtcgaaaagataaaccattaaacgctgatattttctttggtggcaattacactcaatttgaaagccataaagatttatttgaatcttatgtttctccgcaggtttctactgtcatttcagattaccaattgcctagtcatcgcgcaaccccatatacgatcaatggcagtgtactgattgttaataacgaattagcaagaggacttcatattaccagttatgaggatttgctacaaccagctttaaaaggcaaaattgcttttgctgatcccaacagttcatcaagtgccttctcacagctgactaatatattgttagctaagggggggtacacaaacgctgacgcttgggcttacatgaagcgcttgttggtcaatatgaattctattagggctacgagttcttcagaagtctatcaatctgtcgctgagggtaagatgattgttgggctaacctacgaagatccttgtatcaacctgcaaaaaagtggtgccaatgtttccattgtttatccaaaagaaggaacggtgtttgtgccctcctctgttgctattatcaaacatgcgccaaacatgacagaggctaagctctttattaattttatgttatcacgtgatgtgcaaaatgcctttggccaatcaaccagtaaccgacccattcgtcaagatgcccaaaccagtcacgacatgaaagccttagaaacgatagctactttgaaagaggattatgcttatgttaccaagcacaagaaaaaaatagtggctacgtacaaccagttgcgccaacggttggaaaaagctaagtag

SEQ ID NO: 50 - DNA, 792 bp, Streptococcus pyogenes
atgccgactagtattaaagctattaaagaaagcttagaggccgttactagcctcttggaccccctctttcaagaattggcaaccgacactaggtcaggcgtccaaaaagctctaaaaagccgacaaaaggttattcaggccgagttagcagaagaagaacgattagaagccatgctttcttatgaaaaagctctttataaaaaaggttataaagccattgcaggtattgatgaggtgggacgtggtcccttagcaggtcccgttgtggcagcttgtgtgattttacctaagtattgtaaaattaaaggccttaatgattctaaaaaaatccctaaagctaagcatgagaccatttatcaggcagtgaaagaaaaggctttggctatcggtatcggtattattgacaatcagcttattgatgaggtcaatatttatgaagcaaccaaactggccatgctagaagccattaaacagttggagggccaactcacacaaccagattatctcttgattgatgccatgacattggatattgctatttcgcagcagtctattcttaaaggcgatgccaattccttgtctattgcagcagcatcaattgtagctaaggtcaccagagatcagatgatggctaactatgatcgcatttttcctggttatgactttgctaaaaatgcaggctatggcaccaaagaacatttacagggattaaaagcttacggcataacgcctatccatcgtaaaagttttgaacctgttaaatccatgtgctgcgattcaactaatccttaa

SEQ ID NO: 51 - DNA, 1566 bp, Streptococcus pyogenes
atgacagttaaggaagaaacgatgagtattttagaagttaagcagttgagtcacggttttggggatcgggctatttttgaaaatgtgtcatttcgcctcttaaaaggcgaacatattggactagttggggcaaatggtgaaggaaaatcaacctttatgagtatagtcacaggacatttacagcctgacgaaggaaaagtagagtggtcgaagtatgtcactgcaggttacctggatcaacatacagtgttggaatcaggacaaaccgttcgtgatgtcttgcgaactgcttttgatgagttatttaagaccgagaatcgtattaatgagatttacgcgtcaatggcagatgataaagctgatattgctgttttgatggaagaagtaggtgagcttcaagatcgtttagaaagtcgtgatttctatactttggatgctaagattgatgaagtagcgcgtgcgcttggtgttatggattttggaatggagtcagatgttacatccttatcaggtgggcaacgaacaaaggttttattagccaaattactattagaaaaacctgatattctgctattagatgaaccaactaaccatttggatgctgagcatattgaatggttaaaacgctatttacaacattatgaaaatgcttttgtgttgatttcgcatgatatttctttcttaaatgatgtgattaatattgtttatcatgttgaaaatcaaagtttagttcgctatactggggattattaccaatttcaagctgtttatgagatgaaacaatctcaacttgaagcagcctatgaacgtcaacaaaaagagattgctaacttgcaggattttgtcaaccgaaataaggctcgggtagcgacacgtaacatggcaatgtctcgccaaaaaaaacttgataagatggatataattgaacttcaagctgagaaaccaaaaccaaattttgaatttaagcaagctagaactcccagtcgattcatttttcaaacaaaaaatcttgtgattggttatgattacccattgaccaaagaacccttaaatataacgtttgaaagaaatcaaaaaattgctattgttggggccaacggtattggaaaatctactttgctaaaaagtttattaggtgttattgagcctttagaaggtcatattgtcacaggggattttttagaagttggctactttgaacaagaagtgacaggtgttaaccgacaaactccgctagaagtagtttgggatgcttttcctgccttaaatcaggcagaagttcgagcggcactagctcgttgcggactaacatcaaaacatatcgaaagtcaaattcaagtactttcgggtggtgaacaagcaaaagttcgtttttgtttgttgatgaatcgtgaaaataacgtgcttattttagacgaaccaacaaatcatcttgatattgatgctaaaaatgagctcaaacgtgctttaaaagcatataagggttctattttaatggtttgtcatgaacctgatttctacaatgggtgggtaaccgatacttgggattttagtaagttaacctaa

SEQ ID NO: 52 - DNA, 1053 bp, Streptococcus pyogenes
atgaacaagaaatttattggtcttggtttagcgtcagtggctgtgctgagtttagctgcttgtggtaatcgtggtgcttctaaaggtggggcatcaggaaaaactgatttaaaagttgcaatggttaccgatactggtggtgtagatgacaaatcattcaaccaatcagcatgggaaggcctgcaatcttggggtaaagaaatgggccttcaaaaaggaacaggtttcgattattttcaatctacaagtgaatctgagtatgcaactaatctcgatacagcagtttcaggagggtatcaactgatttatggtatcggctttgcattgaaagatgctattgctaaagcagctggagataatgaaggagttaagtttgttattatcgatgatattatcgaaggaaaagataatgtagccagtgttacctttgccgaccatgaagctgcttatcttgcaggaattgcagctgcaaaaacaacaaaaacaaaaacagttggtttcgtgggcggtatggaaggaactgtcataactcgatttgaaaaaggttttgaagcaggagttaagtctgttgacgatacaatccaagttaaagttgattatgctggatcatttggtgacgctgcaaaaggaaaaacaatcgcagcagctcagtatgcagcaggtgctgatgttatttaccaggcagcaggaggcactggagcaggtgtatttaatgaagcaaaagctattaatgaaaaacgtagtgaagctgataaagtttgggttattggtgttgaccgtgatcaaaaagacgaaggaaaatacacttctaaagatggcaaagaagcaaactttgtacttgcatcatcaatcaaagaagtcggtaaagctgttcagttaatcaacaagcaagtagcagataaaaaattccctggaggaaaaacaactgtctatggtctaaaagatggcggtgttgaaatcgcaactacaaatgtttcaaaagaagctgttaaagctattaaagaagcgaaagcaaaaattaaatctggtgacattaaagttcctgaaaaatag

SEQ ID NO: 53 - DNA, 867 bp, Streptococcus pyogenes
atgaaaatgaaaaaaaaattctttttgttaagtcttttggccctatcaactttctttttatccgcatgttctagctggattgataaaggtgagtcaataaccgctgtaggatcaacagcactacaacccttagtagaagcagtagctgatgaatttggaagcagtaatctaggcaagactgtcaatgttcaaggtggtggttcaggtacagggttgtctcaagttcaatcaggagctgtccaaattggaaatagtgatgtctttgcggaagaaaaagatggtattgatgcttctaaattagttgatcatcaagtagctgttgcaggacttgcagttattgccaatcctaaagtcaaggtttccaatctcagtagtcagcagttgcaaaagattttttcaggagaatataccaattggaaacaagttggaggagaagatcttgcgatttcagtgatcaaccgagcagcaagttctggctcacgagcaacctttgacagtgttatcatgaaaggggtcaacgctaaacaaagtcaagagcaagactccaatgggatggttaaatcgattgtttcacaaacaccaggtgccatttcttacctttcctttgcctacgttgattcatctgttaaatctttgcaattaaatgggtttaaggcaaatgctaagaacgtggctacaaatgattggccaatctggtcctacgaacacatgtataccaaagataaaccaacagggttgaccaaggaatttcttgattatatgttttcagatgaagtacaacagaacattgttacacatatgggatatatttcgataaatgatatggaagtggtcaaatctcatgatggaaaagtaacaaaaaggtaa

SEQ ID NO: 54 - DNA, 2175 bp, Streptococcus pyogenes
atgacgcacaaaataaaagtattgctgcttgcgataatgtctatttttttgacatgcaatattgcaagtgctgaaactattgctattgtttcagatacagcttatgccccatttgaatttaaagactcagatcaaatttacaaaggaattgacgttgatattattaatgaagtagccaaacgtcaatcttgggatttcagtatgagtttcccgggttttgatgcagctgtaaatgctgttcaatctggtcaagcgagtgctctaatggccggtacaaccattacgaatgctcgtaagaaagtctttcatttctcagagccatattacgataccaaaattgtcattgcgacacgtaaagccaatgccatcaaaaaatacagtgacttaaaaggaaaaacggtcggtgttaaaaatggaacagcggctcaagcctttttgaataactataaaaaaaagtatgattatactgttaaaacatttgacacaggtgatcttatgtataatagtttatctgctggttctattgccgctgttatggatgatgaggcggttatccaatacgcaatcagccaaaaccaagatattgctattaacatgaaaggagagcccattggaagctttgggtttgctgtcaaaaagggaagcggatatgattatctagttaatgatttcaatacagctcttaaagctatgaaagctgatggtacctaccaagctatcatgaccaagtggttaggcacagatgataaagctaccaccagtcaggcaacgggaaatccatctgccaaagctacacctacaaaggacagttataaaattgtctctgattcgtcttttgcaccgtttgaatttcaaaatggtaagggcaaatacgttggtattgacatagaattaatcaaagctattgctaaacaacaaggtttcaaaattgaaatcgctaatccaggtttcgatgctgccttaaatgctgtgcaatctagccaagcagatggggtcattgctggtgcaactattactgacgctcgtaaagctatctttgatttttctgatccttattatacttctaatatcattttagctgttaaagctggaaaaaacatcaagaactatgaagacttagacagaaaaacagtcggtgctaaaaacggcacttcatcttactcttggttaaaagaaaacgctcctaaatatggttataatgtcaaggcatttgatgatggttctagcatgtatgatagcttaaattcaggttctgtagatgctatcatggatgatgaggcggttcttaaatacgctatctctcaaggtcgtcgctttgaaacacctcttgagggcatttctactggtgaagttggttttgctgtcaagaaaggaactaatccagaattaatcgaaatgttcaacaatggcttagctgctctcaaaaaatctggtcagtatgatgacattatagataaataccttgactctaagaaagctgcaactccttctgaaaaaggtgctgatgagtctactatttcaggcctattatcaaataactacaaacaactattggcaggacttggaaccacgctcagtttaacccttatttcatttgctattgctataattatcgggatcatctttgggatgatggccgtgtcaccaactaaatcacttcgacttatttcaacggtctttgtggacgttgttcgagggattcctttgatgattgtggctgccttcattttctggggagtaccaaaccttatcgagagtatgaccggccaccagtcaccgattaatgatttcttagctgctacaattgcactgtcacttaatggcggagcctatattgctgaaattgttcgcggtggtatcgaagctgttccagcagggcaaatggaagctagtcgaagtcttggtttgtcttacggaaccacgatgagaaaagtaattctcccacaagctgtgaaactaatgttacctaactttatcaatcagtttgttatttcattgaaggatacaacaatcgtctcagcaattggtttagtggaactcttccaaacaggtaaaatcattattgctagaaattaccagtcgttccgtatgtatgctattttagcaattatttaccttatcatgattatactcttaacaagacttgcaaaacgtttagaaaagaggcttaactaa

SEQ ID NO: 55 - DNA, 654 bp, Streptococcus pyogenes
atgggaaaagaaataaaagtgaaatgctttttgcgtagatcagcttttggattagttgcggtgtcagcatcagtattagtcggttcaacagtatctgctgttgactcacctatcgaacagcctcgaattattccaaatggcggaaccttaactaatcttcttggcaatgctccagaaaaactggcattacgtaatgaagaaagagccattgatgaattaaaaaaacaagctattgaggataaagaagctacgacagctatagaagcagcaagttcagatgccttagaagcattagcggatcaaacagacgctttacaatcagaagaagctgcggttgttaaagcggataacgctgctagtgacgccttagaagcattggcggatcaaacagacgctttacaatcagaagaagctgaagtagttcaatcagataacgctgctagtgacgcctgggaaaaagcagcaactccaatcgctttagatgttaagaaaactaaagatacaaaacctgtagttaaaaaagaagaaagacaaaacgttaatacccttcctacaactggtgaagagtctaacccattctttacagctgctgcgcttgcaataatggtaagtacaggtgtgttagttgtaagttcaaagtgcaaagaaaattag

SEQ ID NO: 56 - DNA, 2379 bp, Streptococcus pyogenes
atgaaaacgaaaaaagttattattttagttggtctattgttatcatctcagttgactttgatagcttgtcaatcacgaggtaatggtacatatcccattaaaacgaaacaatcacgtaagggaatgacgtcaaacaaaattaaaccgattaaaaaaagcaaaaagacaaacaagactcacaaaggtgtggcgggtgtcgattttcctacagatgatgggtttattttaaccaaagactcaaaaatcttatcaaaaacagatcagggaatcgttgttgaccatgatggtcattcgcattttattttttatgccgatttaaagggaagtccatttgaataccttattccaaaaggagcaagtttagctaagccagctgttgctcagcgagcagctagtcaagggacttctaaagtagcagatcctcatcaccattatgaatttaacccagcggatattgtggctgaagatgctttaggctacacggttcgccacgatgatcacttccattatattttgaagtcaagcttatcaggtcagacacaggcacaagctaaacaggttgctactcgcttgccacaaaccagtagccttgtttcaacagctacagctaatggtattccaggcttgcatttcccaacctcagatggttttcaatttaacggtcaaggtattgttggggtaacaaaagacagtattttagtggaccacgatggtcacttacatcctatttcttttgcggaccttcgtcagggtggctgggcacatgtggcagatcaatacgatcccgctaaaaaagcagaaaagccagcagaaacccatcagacaccagagctatctgaacgtgaaaaggaataccaagaaaaattagcttatttggcagaaaaattggggattgatccatcaactattaaacgtgtggaaacacaagacggtaaacttggtttggaataccctcaccatgaccacgcacacgtattgatgttatctgatattgaaatcggaaaagacattccagatccacatgctattgagcatgcccgtgaattggaaaaacataaggttggaatggataccttgcgtgccttagggtttgatgaagaagtgattttggatatcgttcgcactcacgatgctccaaccccattcccatcaaatgaaaaagatccgaatatgatgaaagaatggttagcaacggttatcaaacttgacttgggcagccgtaaagatcctttgcaacgtaaaggactttcactgttacccaacttagaaactttaggaattggctttacaccaatcaaagatatctcacctgttttgcaatttaaaaaattgaaacagttgttaatgacaaaaacaggggtgactgattatagatttttggataatatgccacagttagaaggcattgatatttcacaaaacaatctcaaagatattagtttcttgagcaaatataaaaacttaactctagtagcggctgctgataatggtattgaagatattaggccgcttggtcaattaccaaatctcaaattcctcgtattgagtaacaataagatttctgatttaagcccactggcatcgttacatcaattgcaagaattgcacattgataataatcagattacagatttaagccctgtttctcataaagaatcattgacggttgttgatttatcaagaaatgctgatgttgacttagcaacacttcaagcacccaaattagaaacgttaatggtcaatgataccaaggtttctcatttggatttcttgaaaaataatcctaatctatctagcctatctattaaccgtgcgcaattgcaatctcttgaaggtattgaagcaagtagcgtcattgtcagagtagaagcagaaggtaaccaaattaaatcgcttgtgcttaaagacaagcaagggtcacttactttcttggatgtgacaggcaaccagttgacttctctagaaggtgttaataattttacagcacttgacattttaagcgtgtctaaaaaccaattaacaaatgtcaacctatctaaacccaataagacagttactaacattgatattagtcataacaatatctcattagcagaccttaaattgaacgagcaacatattccagaagccattgcgaaaaacttcccagcggtttacgaaggttctatggtaggtaatggaacagctgaagaaaaagcagctatggctactaaggcgaaagaaagtgctcaagaagcatcggaatcacatgactacaaccataatcatacctatgaagatgaagaaggtcatgctcacgagcacagagacaaagatgatcacgaccatgaacatgaggatgaaaatgaagctaaagatgagcaaaaccatgctgactaa

SEQ ID NO: 57 - DNA, 1428 bp, Streptococcus pyogenes
ttggcaaaacaatataaaaatttagtgaacggtgaatggaaactatcagaaaacgagattaccatttacgcaccagcaacaggtgaagagttaggatcagttccagcgatgacgcaggcagaggtagatgctgtttacgcttcagctaaaaaggctctatcagattggcgcgctttgtcttatgtggaacgtgcagcttaccttcataaagcggctgatattttagtacgtgatgctgaaaagatcggcgcgattctttcaaaagaagtagccaaaggtcacaaggcagctgtcagtgaagttattcgtaccgctgaaatcattaattatgcagcagaagaagggcttcgtatggaaggtgaagttcttgaaggtggtagcttcgaagctgcaagtaagaagaagattgctattgttcgtcgtgaaccagttggtttagttcttgccatctcaccttttaattatcccgttaacttggcaggttctaaaattgctccagctcttattgcaggaaatgttgttgctcttaaaccaccaacacaaggctctatttctggtttgttactagcagaagcttttgcagaagctggtattccagcaggtgtctttaataccattacagggcgaggttctgttatcggtgattatatcgttgagcacgaagcggttagctttatcaactttacaggttctactccaattggggaaggaatcggtaaattagcgggtatgcgaccaattatgcttgagcttggcggtaaggattctgctatcgttttggaagatgcagatcttgctttagcagcgaaaaatattgtagccggtgcttttggttactcaggccaacgttgtacagcggttaaacgtgttcttgtgatggacaaggtggcggatcaattggcggctgagattaaaacacttgttgaaaaactaagtgtcggaatgcctgaagacgatgctgatattacaccattaattgatacatcagctgctgattttgttgaagggttgattaaagatgcaactgataagggagctactgctttgacagcctttaatcgtgaaggcaatcttatttcacccgttctctttgatcatgtgacaactgacatgcgtttggcatgggaagagccgttcggcccagtattaccaattattcgtgtaaccactgtagaagaagccatcaagatttctaatgagtctgaatatggtttgcaagcttctatttttacaactaatttcccaaaagcttttggcattgctgagcaattagaagttggaactgttcaccttaacaataaaacacaacgtggaacagataatttcccattcttaggcgctaaaaaatcaggtgcaggggtacaaggagttaaatattctatcgaagctatgacaactgttaaatctgttgtatttgatatccagtaa

SEQ ID NO: 58 - DNA, 2160 bp, Streptococcus pyogenes
atgagtctcaaagatcttggcgatatttcatattttcgcctaaataatgaaattaaccgtcctgttaatggtaaaattccacttcataaagacaaagaagctttaaaagctttttccgctgaaaatgtgctgccaaacaccatgtcttttacttccattacggaaaaaattgagtatttaatctcaaatgattacattgaatcagcttttattcagaaataccgccctgaatttattactgaattagatagcataatcaaatcagaaaattttcgctttaaatcatttatggcagcctacaagttctaccagcaatacgccttaaaaacaaatgatggagagcattatttagaaaaccttgaagaccgtgtcttgtttaatgctttgtattttgcagatggtcaagaagacttagcaaaagatttagccgttgaaatgattaaccaacgttaccaaccggctactccttcctttttaaatgctggtcgaagccgtcgtggtgaattggtctcttgtttcttgattcaagtaactgatgacatgaactctatcggacgttctatcaactctgctttgcaattatcccgtattggtggaggagttgggattaccttgtctaacctccgtgaagctggcgcaccaatcaaaggctatgctggtgcagcctcaggagttgttcctgttatgaaattatttgaagatagtttttcttattcaaatcaacttgggcaacgtcaaggagctggtgttgtttacctaaatgtttttcatcctgatatcattgctttcttatctactaaaaaagaaaatgccgatgaaaaggtgcgtgttaaaaccttgtcactagggattaccgttcctgataaattctacgaattagctcgtaaaaacgaggacatgtatctctttagtccttacaatgttgaaaaagaatatggcattccctttaactatctcgacattaccaatatgtacgatgagttagtggcgaaccctaaaattactaagactaaaattaaagctcgtgatcttgaaacagagatttcaaaattacaacaagaatctggttacccttatatcatcaatattgatacagctaataaagctaatcctatcgatggaaaaatcatcatgagcaacttgtgttctgaaattttacaagttcaaacacctagccttatcaatgatgcgcaagagtttgtagaaatgggaactgatatttcatgtaacttaggttccactaatatcctgaacatgatgacctcaccagactttggccgttctattaagaccatgacacgtgccctaacttttgttactgattcatcaagcattgaagctgttccaaccattaaacatggcaatagccaagctcatacttttggccttggagctatgggactacattcttaccttgctcaacatcatattgaatatggcagtccagaatccatcgagtttactgatatttactttatgctcctgaattattggaccttggtcgaatccaataacatcgctcgtgagcgccaaactacctttgttggctttgagaactctaagtacgctaatggtagttactttgataaatacgttacaggacactttgttccaaaatctgatttggtgaaagatctgttcaaagaccattttattccgcaagcttcagattgggaggctcttcgcgacgccgttcaaaaagatggtctttatcatcaaaaccgactagcagttgctccaaatggctctatttcttatatcaatgactgctctgcttctattcacccaatcacacaacgcatcgaagagcgtcaagaaaagaaaattggtaaaatctactatcctgcaaatggtttgtctacggataccattccttactatacatctgcttacgatatggacatgcgcaaagttattgatgtctatgccgctgcgaccgaacatgtggaccaaggcttgtcattaactctattccttcgtagtgagttgcctatggagctttatgagtggaaaacacaaagcaaacaaaccactcgtgatttatccatcttacgaaactacgctttcaataaaggcattaaatctatctactatatccgtacctttacggatgatggggaagaagtgggcgcaaaccaatgtgaatcttgtgtcatttaa

SEQ ID NO: 59 - DNA, 2619 bp, Streptococcus pyogenes
atgaaagaattatcgtctgcacaaatccgccaaatgtggttggatttctggaaatctaaaggacattgcgttgagccttcagctaacttggttcctgtgaacgacccaacgcttctttggatcaactcaggtgttgcaaccttgaaaaaatattttgatggttcagtgattccagaaaatccacgtattaccaatgcacaaaaatcaattcgtactaatgatattgaaaatgttggtaaaacagcacgtcaccatactatgtttgaaatgcttggtaacttctcaattggagactatttccgtgatgaagctattgagtggggatttgaactcttgacaagtccagactggtttgatttccctaaagacaagctctacatgacttattacccagatgacaaggattcgtataaccgttggattgcttgtggcgttgaaccaagtcacttggtgccgatcgaggataacttctgggaaatcggtgctggtccttcaggtccagatacggagattttcttcgaccgtggtgaagatttcgatccagaaaatatcggacttcgcctcttggctgaagatatcgaaaacgatcgttacatcgaaatctggaacatcgttctctcacaattcaatgctgacccagccgtaccacgttcagaatacaaagaattaccaaacaaaaacattgatacaggtgctggtcttgaacgtcttgcagctgttatgcaaggggcaaaaacaaactttgaaactgacctcttcatgccaatcatccgtgaagtagagaagttgtcaggtaaaacttacgatccagatggcgacaacatgagtttcaaggttatcgctgaccacatccgtgcgctttcatttgctatcggtgatggtgcgcttcctggaaatgaaggtcgtggttacgttcttcgtcgtcttctccgtcgtgcggttatgcacggtcgccgtcttggcatcaacgaaactttcctttacaaattggttccgactgttggacaaatcatggaaagctactacccagaagtgcttgaaaaacgtgattttatcgagaaaatcgttaaacgtgaggaagaaacatttgctcgtactatcgatgcaggtagcggtcacttagattcattgcttgcgcagcttaaggctgaaggtaaggatactcttgaaggtaaagatatcttcaaactttatgatacttatggattcccggttgaattgacagaggaattggcagaagatgcaggctacaagattgaccacgaaggctttaagtcagccatgaaagaacaacaagaccgtgcgcgtgcagctgttgttaagggtggttcaatggggatgcaaaatgaaaccctagctggtattgttgaagaatcacgattcgaatacgacacatatagtcttgaatcaagtctttcagtcatcatcgctgataatgaacgtaccgaagctgtttcagaaggtcaagcccttcttgtctttgctcaaacaccattctatgctgaaatgggtggacaggttgctgacacaggtagaatcaaaaatgataagggtgacacagttgctgaggttgttgatgttcaaaaagcaccaaatggtcaacctctacacactgtaaacgttttagcatcactttcagttggaacaaactacacacttgaaatcaacaaagagcgtcgtttggctgttgagaaaaaccacacagctactcacttgctccatgcagctcttcacaatgttatcggtgaacacgcaactcaggctggttcattgaacgaagaagaattcttgcgctttgattttactcactttgaagcagtaagcaatgaggaacttcgtcacattgaacaagaagttaatgagcaaatttggaacgctcttacaatcacaacgactgaaactgacgttgaaaccgcaaaagagatgggagcaatggcgctttttggtgagaaatatggtaaagtggttcgtgtggttcaaattggtaattattctgttgaactttgtggtggaactcacttaaataattcttcagaaatcggtctcttcaagattgtcaaagaagaaggtattggttcaggcactcgtcgtattattgcagttactggtagacaagcttttgaagcttatcgtaaccaagaggatgccctaaaagagatcgctgctactgtaaaagctccgcaattgaaagatgcagcagctaaagtacaagctcttagcgactcgcttcgtgatcttcaaaaagaaaatgcagaacttaaagaaaaagcagcagctgcagcagctggtgatgtctttaaagatgttcaagaagctaagggcgtgcgcttcattgctagtcaagttgatgttgcagatgcaggggcacttcgtacatttgctgataactggaaacaaaaagactactctgatgtgcttgttctcgtagcagctattggtgagaaggttaatgtccttgttgcaagcaaaaccaaagatgtccacgctggtaacatgatcaaagaattggcaccaattgtagcaggtcgtggtggaggtaaaccagacatggctatggcaggtggtagcgatgcaagtaaaattgcagagctgctagcagcagttgctgaaatagtgtaa

SEQ ID NO: 60 - DNA, 1056 bp, Streptococcus pyogenes
atgaaaaactcaaataaactcattgctagtgttgtgacattggcctcagtgatggctttagcagcttgtcaatcaactaatgacaatactaaggttatttcgatgaaaggtgatacaattagcgttagtgatttttacaatgaaacaaaaaacacagaagtatcgcaaaaagcgatgctaaatctggtaattagtcgtgtttttgaagctcaatatggtgataaggtttcaaaaaaagaagttgaaaaggcgtatcataaaacagctgaacagtatggcgcttcattctctgctgctttggcacaatcaagcttgacacctgagacttttaagcgtcagatccgctcttcaaaattagtagaatatgcggttaaagaagcagctaaaaaagaattgacaacacaagaatataagaaagcatatgaatcttatactccaacaatggcagtcgaaatgattactttagataatgaagagacagctaaatcagtcttagaggaactaaaagccgaaggcgcagactttacagctattgctaaagaaaaaacaacaacacctgagaaaaaagtgacctataaatttgattcaggtgcgacaaatgtaccgactgatgtcgtaaaagcggcttcaagtttgaatgagggtggcatatcagacgttatctcggttttagatccaacttcttatcaaaagaagttttacattgttaaggtgactaaaaaagcagaaaaaaaatcagattggcaagaatataagaaacgtttgaaagctatcattatagctgaaaaatcaaaagatatgaatttccaaaacaaggttattgcaaatgcattggataaagctaatgtaaaaattaaagacaaagcttttgctaatattttggcgcaatatgcaaatcttggtcaaaaaactaaagctgcaagtgaaagttcaacaaccagcgaatcatcaaaagctgcagaagagaacccatcagaatcagagcaaacacagacatcatcagctgaagaaccaactgagactgaggctcagacgcaagagccagctgcacaataa

SEQ ID NO: 61 - DNA, 597 bp, Streptococcus pyogenes
gtgctttatccaacacccattgcaaagttaattgacagttactctaaacttccaggaattggtatcaagacggcgacgagattagccttttatactattggaatgtcaaatgaagatgtcaatgattttgctaaaaacttattagcagctaaaagagaactgacctattgttcgatttgtggaaaccttaccgatgacgatccttgtcacatttgcacagacacgagtcgtgatcagacgaccattctggtagtagaagatgctaaagatgtttctgccatggaaaaaatccaagagtatcatggctattatcatgtgcttcacggcttgatttcgcctatgaatggtgtggggccagatgacatcaaccttaaaagtttaattacccgtctaatggatggtaaggtgagcgaagttatcgtagctaccaatgccacagcagatggggaagcaacgtccatgtatatttcacgtgtcttgaaaccagccgggattaaggtaactcgtttggcaagaggtctcgcagtaggttcagatattgagtatgctgatgaagtaacattattgagagctattgagaatcgtactgaactttaa

SEQ ID NO: 62 - DNA, 807 bp, Streptococcus pyogenes
atggatatgtctaaatcaaatcgtcgtacttggcaaggtttagttgttattttaatagctattctcaccacttttaccacaagtactgttacggcagccagaaaaattagaaatttccctgataccacggaaattttgttaggaacgaaggcgactgagacaccaggaatcttaccattcactggtagctaccaattagttttgggcgatcttgacaatctgcaaaggccaaccttcgcacacatccagctaaaagatcaagatgagcctaatattaaacgaaaaggacttaaattcaatcctcctggctggcataattacaaattgactgacgctaatggaaaaacaacttggttaatggaccgtggccatttagttggttaccaatttagcggcttaaatgacgagcctaaaaacctagttacaatgacaaaatatcttaatactggctttagtgacaaaaatcctttaggaatgctctattatgaaaatagattagatagctggttagctctacaccctaacttctggctagactataaagttactcctgtttatcataaaaatgagttagttcctcgccaagtagttctacagtatgttggaattgatgaaaatggagatctacttcaaattaagttaggtagtgaaaaagaaagtgtagacaactttggagtaacatcagttacattagataacgtatctcctttagctgaattggattaccaaacaggaatgatgctagattcaactcaaaacgaagaagatagtaatttagaaaccgaagagtttgaagaagcggcttaa

SEQ ID NO: 63 - DNA, 942 bp, Streptococcus pyogenes
atgactagtaaaaaagcgtgtttatcaagcatcattgtgttagcaagtttaacgtgtggaaatgatactgttagtgccaatcatctctcagcaactggagataagtttgatgattgctcaacacttgttgaaaaagatgtggcccctaaagatgaacttgagatgttagcatggtcctcgtctcaaacaactgatgatgctgacagagactatgaagattttctcgatgatgattcttttatttctcaaaatgaaactgataagatgtttgagaatttaactgatgataggttattaaatgaattagatgaattagatgaagaaaatgaagaagatgaagaagatacaattgagccagagcaaaatgtaataatgcctagtgacgatgagctatttgatttaactgatgctgttgagacacgccttactgtttctagtgctccccatttagaggctgaattgccgaaaccacatttgaggagcctatcagatacagcactgcggtctggtgaaattagaggacatttagataacaaactggacgctttgtctgtaacagctacaaagttagcattaacgatggctcaaaaatttgatttgacaacgcatgtctattctataggtgaaagctttagtgaagtattagctgctcattatgaagacagaaaagcagaatcagctttttctaagaaaaagagatttcaccttcctattgctactccagatgttgttatagaggagttaaggcgcctagtctcttctattggaagttcaaaagaagatgtttcagttccttatagtcggaagctaggtatggcagttgcaaaaagaaaaatagccctgccacaaacgggagagaggttctcttattatccagttttacttggtttaatgatattaggattaacgccgattatgataccaaagaagataaataattag

SEQ ID NO: 64 - DNA, 1149 bp, Streptococcus pyogenes
atggcaaaagataaagagaaacaaagtgatgacaagctcgttttgacagagtggcaaaagcgtaacattgaatttttaaagaaaaagaagcagcaagctgaggaagaaaaaaaactcaaagagaaattattgagtgataaaaaagcgcagcagcaagctcaaaatgcttctgaagcggttgagcttaaaactgatgagaaaactgatagtcaggaaattgagtcagaaacgacgtcaaaacctaaaaaaaccaaaaaagttagacaacccaaggaaaaaagcgcgacacaaatcgcttttcaaaaatccttgcctgttcttttgggggcgctcttactcatggcggtgtctatttttatgatcactccttatagcaaaaagaaagagttttctgtaagaggaaaccatcaaacgaaccttgacgaattaatcaaagctagcaaagtcaaagcatctgactattggttaacgctgttaacttcgcctggtcagtatgaacgaccgattcttcgtactattccatgggtgaaatctgtacatctctcttaccaatttcctaatcactttctatttaacgttattgaatttgaaatcatcgcttatgcacaagttgaaaacggttttcagcctattttggagaatggaaaacgtgtggacaaggtcagggcatcagaactaccgaaatctttcttgattcttaatttaaaagatgagaaagcgatccaacagttagttaagcaattaacgacattacctaaaaaattagtcaagaatatcaagtcagtgtctcttgcaaattccaaaacgacagcggatttactacttattgaaatgcatgacggtaatgtagttagagtaccgcagtcacaactcacattgaaacttccctattatcaaaaattgaaaaaaaaccttgaaaatgatagtatagtggatatggaagtgggaatttatactacaacacaggagattgaaaatcaacctgaagttcctcttacgcctgaacaaaacgcagctgataaagaaggagataagcctggtgaacatcaggaacagacagacaatgattcagaaacgccagcaaatcagagtagtcctcagcaaacaccaccatccccagaaacggtcctcgaacaggcccatggctag

SEQ ID NO: 65 - DNA, 1038 bp, Streptococcus pyogenes
atgaaaagacttaaaaaaatcaaatggtggttagtgggtctgctagctttaatctctttgttgctagcgttattttttccgctaccttattatattgaaatgcctggaggcgcttacgatattcggactgtcttacaagtcaatggcaaagaagacaaacgaaaaggagcttaccagtttgttgcagtgggcattagtcgtgccagcctcgctcagctattatatgcttggctgacaccgtttactgaaattagtacagcagaagatacaacaggcggatacagcgatgctgatttccttcgaattaatcaattttacatggaaacatcacaaaatgcagctatttatcaagctttatccttagctggaaaaccagttacattagattataaaggcgtatatgttttagacgtaaacaacgaatctacttttaaaggaacgctacacttagcagatactgtaacaggtgtaaatggtaaacagtttactagttcagcagaacttattgactatgtttctcacctaaaactaggggatgaagttacggttcagtttacgagtgataataagcctaaaaaaggagttggccgtattatcaaactgaaaaatgggaaaaatgggattggcattgccttgactgatcatacaagtgtcaattcagaagacacagtgatctttagtactaaaggagtaggaggacctagtgctggtctaatgtttactcttgatatatatgatcaaataactaaagaagatttacgcaagggccgtacaattgcaggtacaggaactattggcaaggatggcgaagtaggagatattggtggtgcaggtcttaaagtagttgcagcagctgaagctggtgcagatatattttttgttccgaataatcctgttgataaggaaattaaaaaagttaatccaaatgctataagtaattacgaagaagccaaacgggcagccaaacgactaaagaccaaaatgaagattgttcctgttacgactgttcaagaggcactggtttatcttcgcaaataa

SEQ ID NO: 66 - DNA, 849 bp, Streptococcus pyogenes
atgttggaacacaaaattgattttatggtaactcttgaagtgaaagaagcaaatgcaaatggtgatcccttaaatggaaacatgcctcgtacagatgccaaaggatatggtgtgatgagtgatgtctccattaaacgtaagattcgtaatcgtttgcaagatatggggaagtctatttttgtgcaagctaatgagcgtattgaagatgattttcgttcactggaaaaacgcttttcgcaacattttacagctaagacacctgacaaagaaattgaagaaaaagcaaatgcattatggtttgatgttcgtgcttttggacaagtttttacttatctgaaaaaatcaattggggtgcgtggaccagtttccatcagtatggctaagtccttggagccaattgtcatttccagccttcaaattacgcgtagtaccaatggtatggaagctaagaataatagtggccgctcttctgatacgatggggacaaaacattttgtagattatggtgtgtatgtacttaaaggttctatcaatgcttattttgctgaaaagactggtttttctcaggaagatgctgaggctattaaagaagttttggttagcttgtttgaaaatgatgcgtcgtctgcacgtccggaaggctctatgcgagtttgtgaagtcttttggtttacgcattcaagcaaattgggaaatgtttcaagtgcgcgtgtctttgacttgttagagtatcatcaatcaatagaagaaaaaagcacttatgacgcttatcagattcatctaaatcaagaaaaattggctaaatatgaagcgaaagggttaacgcttgaaatcctagaaggactctag

SEQ ID NO: 67 - DNA, 2706 bp, Streptococcus pyogenes
atggcaactaaaaaagtacatattatttcacacagtcactgggatcgcgagtggtacatggcttacgaacaacaccacatgcgtctgattaacttaatagatgacctgttagaagtttttcaaacggatcctgattttcatagttttcatttggatgggcaaaccattatcctagatgattatttaaaagtacgccccgaacgagaacctgagattagacaagccattgcttcgggaaaactccgtatcggacctttctatatcttacaggacgattttttgaccagcagtgaatccaatgtgcgcaatatgctgattggtaaggaagattgtgacagatggggcgctagtgtgccacttggttattttcctgatacctttggaaatatgggacaaacaccacagctgatgttaaaagccggcctacaagctgctgcctttggtcgtggcattcgtccaactggatttaacaatcaggtggataccagtgaaaaatacagctcccaattctctgaaatcagttggcaaggcccagataacagtcgtattcttggactcctcttcgccaactggtacagcaatggcaatgagatcccgacaacagaagctgaggcgcgtcttttttgggataaaaaacttgctgatgccgaacgcttcgcctcaaccaagcaccttctgatgatgaacgggtgtgatcatcaacccgtacaacttgatgtcaccaaggcaatcgccttagccaaccaactctatcctgactacgaatttgtgcattcctgctttgaagattacttggctgatctcgcagatgatttaccagagaacctttcaaccgtccaaggagagattaccagtcaagaaaccgatggctggtataccctagctaacacggcttctgctcgtatttacctcaaacaggctaataccagagtctctcgccaactcgaaaacatcaccgaacccttagcagcaatggcttatgaggtaacaagtacctaccctcacgaccaactgcgttacgcttggaaaaccctcatgcaaaatcaccctcatgattctatctgtggttgtagtgttgatagcgttcatcgggaaatgatgacgcgctttgaaaaagcctatgaagtcggacactatttagcaaaagaagctgctaagcaaattgctgacgccattgataccagggattttccaatggatagccaacccttcgtcttatttaataccagcggccattccaaaacaagtgttgctgagctcagcctgacctggaaaaaatatcattttggccaacgctttcctaaagaggtttaccaagaagctcaagaatatttggcaagactctcccaatctttccaaattattgacactagtggacaagtgagacccgaagcagaaattttaggcacaagcatcgcttttgactacgatttgcccaagagatccttccgcgaaccttatttcgccatcaaagtgagattacggctaccaataactctcccagccatgtcttggaaaaccttagcattaaagctaggaaatgaaacaactccttcagaaaccgtttccctctacgatgacagtaatcagtgccttgaaaatgggtttctaaaagttatgatacaaaccgatggtcgtctaaccatcaccgataaacaatctggactaatctatcaagacctgttgcggtttgaagattgtggcgatattggaaatgaatatatttctcgccagccaaatcatgaccaacctttctatgcggatcaagggaccatcaagcttaacatcattagcaacaccgctcaagttgctgaacttgaaatccagcaaacctttgccattcctatctccgcagataagctcttacaggctgagatggaggctgtcattgacatcacagaacgccaagcaagacgttcacaagaaaaggctgagctaaccttaacaacccttatccgcatggagaaaaataatcctcgcctccaattcaccacacgttttgataaccaaatgactaatcatcgcttgcgcgtcctattcccaacgcaccttaaaacagaccatcatctagctgacagtatttttgaaactgtcaaacgtccaaatcatccagatgccaccttttggaagaatccaagtaacccacagcaccaagaatgctttgtgagtctctttgatggtgaaaatggagtcactattggtaactatggcctcaacgaatatgagatcttaccagataccaacaccattgccatcactctcttacgttctgttggcgaaatgggcgactggggttacttcccaacacctgaagcccagtgtcttggcaaacacagcctttcttatagttttgaaagcatcactaagcaaacacaatttgccagctactggcgagctcaagaaggccaagtccctgttattaccacacaaacaaaccaacacgagggaacattagccgcagaatatagctatttgacgggtacaaacgaccaagttgccctcacagctttcaaacgtcgcttagcagacaatgcccttatcacgcgcagctataatctctcaaacgataaaacttgtgactttagcctaagcctgccaaactacaatgccaaggtcactaatttgttagaaaaagacagcaagcaaagcacacccagccaacttggcaaagcggaaattttaactctagcttggaagaaacaataa

SEQ ID NO: 68 - DNA, 777 bp, Streptococcus pyogenes
atgaaaatcactaaaattgaaaagaaaaaacgcctctaccttatcgaattggataatgacgaatccctttatgtaacagaagatactattgttcggtttatgttgagtaaagataaagtccttgacaatgatcagcttgaagacatgaaacattttgcccaactgtcctacggcaaaaatttagccctttattttctttcctttcaacaacgcagcaacaagcaagttgctgattacctgcgcaagcatgagattgaagaacacattattgctgacatcatcactcaactccaagaagaacaatggatagacgacaccaaattggctgatacctacattcgccaaaatcagttaaatggtgataaaggtccccaagtcttaaaacaaaaattattacaaaaaggcattgcaagtcatgacattgatcctatcttatctcaaactgactttagccaactcgctcaaaaagtaagccaaaaactctttgacaaatatcaagaaaaattgccaccaaaagccttgaaagataaaatcacccaagcattactgaccaaaggcttttcatacgatctagctaaacatagcctcaatcaccttaattttgaccaagataatcaagaaatagaagatcttcttgacaaagaattagacaaacaatatcgtaaactcagtcgcaaatatgatggttataccttaaagcaaaagctctatcaggctctctaccgaaaaggctacaacagcgacgacattaattgcaagttaagaaattatttatag

SEQ ID NO: 69 - DNA, 666 bp, Streptococcus pyogenes
atgatctgtctactatgtcaacaaattagtcaaacaccaataagtattacagaaatcatctttttaagacgtatctcttcaccgatttgtcaacaatgtcaaaaaagctttcaaaagataggaaaaagtgtttgtgcgacatgttgtgcaaactcagatataatagcttgtcgagattgtctaaaatgggaaaacaaaggatacaatgtaaatcatagaagcttatattgttataatgctgctatgaaagcatacttcagtcaatataagtttcaaggagactatttattaagaaaagtttttgcagtagaacttgccgatgttatcaccaagtactataaaggctatatcccagtcccggttcctgtaagtcccggttgttttcgagaaagacaatttaatcaagtgagcgctattcttgaggcagctaatgttagctacctttctctttttgaaaagctagataatactcaccaatcttccagaacaaaaaaagagagattattagtagaaaaatcttatcgactactaaaagtatcaaacattcctgataaaatccttatagtagatgatatttatactactggtagtacaattatcgctcttagaaaacaattggctaaagtagcaaatagtgacattaaaagtttgtcaattgcacgttaa

SEQ ID NO: 70 - DNA, 1014 bp, Streptococcus pyogenes
atgaaatccttttctcttactttttcatttctaaaccttttgaagtatggtacaattaaagttatgacaaaagaatttcatcacgtgaccgtactccttcacgaaacagtggacatgcttgacataaagcctgatgggatttatgttgatgcgacgctaggtggctcaggccactcagcttatttgttgtccaaacttggtgaagaagggcacctctattgttttgaccaagaccaaaaggctattgacaatgcacaagttaccctcaaatcttatattgacaaaggacaggtaacttttattaaagataattttagacacctcaaagcacgtttaacagcgcttggagttgatgaaattgatggtatcttatatgaccttggtgtttccagcccgcaattggatgaaagagaacgagggttttcttataaacaagatgctccattggatatgcgcatggatcgtcagtcgctcttaacagcttacgaagtggtgaatacctatccattcaatgatttggttaagatttttttcaaatatggtgaagataaattctccaagcagatcgctcgaaaaattgaacaagcaagagctattaagcctattgagacaacaacagagttggcagaattgattaaggcagcaaagccagctaaagagttgaagaaaaaaggccaccctgctaaacagatttttcaagctattcgcattgaagtcaatgatgaattgggagcggccgatgaatctattcaggacgctatggaattattagcccttgatggtcgtatctcagttattaccttccattctctggaagatcgcctaaccaagcagttgtttaaagaagctagtacggtggatgtgccaaaagggcttcctctaattcctgaagatatgaaacctaagtttgaacttgtttcacgtaagccgatcttacctagtcattcagagttaacagctaataaaagggcacactcagccaagctacgtgttgccaaaaaaattcggaaataa

SEQ ID NO: 71 - DNA, 792 bp, Streptococcus pyogenes
gtgacaacgacggaacaagaacttaccttgactcccttacgtgggaaaagtggcaaagcttataaaggcacttatccaaatggggaatgtgtctttataaaattaaatacgacccctattctacctgccttagcaaaagaacagattgcgccacagttactttgggccaaacgcatgggcaatggtgatatgatgagtgcccaagaatggcttaacggccgtacattgaccaaagaagatatgaacagtaagcaaatcattcatattctattgcgccttcacaaatctaaaaaattagtcaatcaactgcttcagctcaattataagattgaaaacccatacgatttattggttgattttgagcaaaatgcacccttgcaaattcagcaaaattcatacttacaagctatcgttaaagaattaaaacggagcttaccagagttcaaatcagaagtagcaacgattgtgcatggagatattaaacatagcaattgggtgattactactagtggtatgatttttttagtagattgggattctgttcgtctaactgatcggatgtatgatgttgcttacctgttgagccactatattccacggtctcgttggtcagaatggctgtcttattatggctataaaaataatgacaaggttatgcaaaaaattatttggtatggtcaattttctcacctgacacaaattctcaagtgttttgacaagcgtgacatggagcatgtgaatcaggagatttatgccctcagaaaatttagagaaatatttagaaagaaataa

SEQ ID NO: 72 - DNA, 2016 bp, Streptococcus pyogenes
atgatattaacagctcctatgtccaacttaaagggatttggaccaaaatcagcagaaaaatttcagaaattagatatttatacagtagaagatttactgctttattatccgtttcgctatgaagattttaaatcaaaatctgtttttgatttagtggatggtgaaaaagcagtcattacaggcttagtcgttactccagctaatgtacaatattatggttttaaacgtaaccgtttaagtttcaaattgcgtcaaggggaagctgtcttaaatgttagtttttttaatcaaccctatttagctgataaaatagaacttggtcaagaggtagctgtttttggtaaatgggatgccactaaatcggctattactgggatgaaggttttagctcaagttgaagatgacatgcaacctgtttatcgcgtagctcagggaatttcacagtctactttgattaaagctattaagtcagcttttgaaatcgatgcgcatttggaattgaaggaaaatttaccagctactttattggaaaaataccgattgatgggtcgtagtcaggcttgtttagctatgcatttcccaaaagatatcacagagtataagcaagcgctccgtcggattaaatttgaagaattattttactttcaaatgaaccttcaagttttgaaagccgaaaataaatctgaaacaaatggtttgcctattctttatagtaaacgtgctatggagacaaagatttcctctttaccttttattctaacgaatgctcaaaagcgctctttagatgacatattatctgatatgtcatcgggagctcatatgaatcgtttattgcaaggagatgtaggatcaggaaagacagtcattgctggtctatcaatgtatgcagcttatacagcaggttttcaatcggctttgatggttccaacggaaatcctagctgaacaacactacattagtctgcaagagttatttccagatttatcaatcgctatattaacttcgggtatgaaagcagctgtcaagcgtacggttttagcagctattgcaaatggctcggttgatatgattgtaggaactcatgctcttatccaagactcggtacagtaccataaactggggcttgtcattacagacgagcaacatcgttttggtgttaaacagcgtagaattttccgtgaaaagggagaaaatcctgatgttttaatgatgacagccaccccaattccccgaactctagcaatcacagcttttggagaaatggatgtttctattattgatgaattacctgccggtcgtaaacctattatgacacgctgggtgaaacacgagcagctaggtactgtgttggaatgggtaaaaggtgaattgcaaaaagatgctcaagtgtatgtcatttcaccgttgattgaagaatcagaagctttagatttaaagaatgcagtagcattgcatgctgaattatctacttattttgaaggaattgctaaggttgctcttgtacatggacgtatgaaaaatgatgaaaaagatgctataatgcaagatttcaaggataaaaaaagtcatattttagtatccacaacagttattgaagtaggggtaaatgtcccaaatgcaacgatcatgattattatggatgccgatcgttttggattaagtcagttacatcaacttcgtgggcgtgttggtcgtggatataaacaatcatacgctgttttagtggctaatcccaaaactgattcggggaaaaaacgaatgacaatcatgacagaaacgacagatggtttcgttttagctgagtcggatttaaaaatgcgtggttctggtgaaatctttggtactcgtcagtctggaattccagaatttcaagtagctgatatcgttgaggattatcctattttagaagaagcacgcaaagtttctgcagcgattgtttctgatcctaactggatatatgaaaaacagtggcaattagtggcacaaaatattagaaaaaaagaagtttatgattaa

SEQ ID NO: 73 - DNA, 3828 bp, Streptococcus pyogenes
atgaaaaaaatcagcaaatgtgcgtttgtggcaatatctgcccttgttctcattcaggctactcaaactgtaaaatcacaagagcctttagttcagtcacaactcgtgacaacagtagctttaactcaggataatcgacttttagttgaagagataggcccttacgctagtcaatcagctggaaaagagtattataaacatattgaaaagattattgttgataatgatgtctatgaaaaaagcctggagggcgagcgaacctttgatattaactaccaagggattaagatcaatgctgaccttattaaagacggtaagcatgaattgactattgttaataaaaaagatggtgatatcctaattacctttattaaaaagggcgataaagtgacctttatttcagctcaaaaattaggaacaacagatcatcaggattcattaaaaaaagatgtgctcagtgataaaacagtgccacaaaaccaaggcacacaaaaagttgttaaatctgggaaaaatactgctaacttgtcattaataacaaaattgagtcaagaagatggtgcaattttatttccagaaattgatcgttattctgataacaaacagataaaagcattgactcagcaaatcacaaaggttacagtcaatggtacagtttataaagatcttatttcagattctgtaaaagatactaatggctgggtctcgaatatgacagggcttcatcttggaacaaaagctttcaaagatggagaaaatacaatcgtgatatcctcaaaaggatttgaagacgttactattaccgttaccaagaaagatggtcaaatccattttgtatctgccaaacaaaaacaacatgtgactgctgaagacagacaatcaacaaagttggatgtcaccactttggaaaaagctatcaaagaagcggatgcgattattgctaaagaaagcaacaaagacgcggtcaaagatctggctgagaaacttcaagtcatcaaggattcttacaaagaaatcaaagatagtaagctactcgccgatactcatcgactgttaaaagataccatcgagtcttatcaagcaggtgaggtttctattaacaatctcacagaaggaacctatacgctaaactttaaagctaataaagaaaactcagaagagtcctccatgcttcaaggtgcttttgataaaagagccaaattagtggttaaagcagatggtacaatggaaatttccatgcttaatactgctttgggacaatttttgattgacttttctattgaaagcaaagggacctacccagcagcagtgcgtaaacaagttggccaaaaagatatcaatggtagctatattcgaagcgaatttaccatgcctattgatgatttggataaattacacaaaggtgctgttttggtatcagccatgggaggtcaagaaagtgatttaaaccactatgacaaatacaccaaacttgacatgacctttagtaagaccgttaccaaaggctggagtggttatcaggtagaaactgatgataaagaaaaaggggttgggactgaacgtcttgaaaaagttttagttaaacttggcaaagatttagacggcgatggtaaattatcaaaaacggaattagaacagattcgaggcgagttgcgtctagaccattacgagttaactgatatttctttattgaaacatgctaaaaatattacagaactacatctggatggaaaccaaattacggaaattccaaaagagttatttagtcaaatgaagcaacttcgatttcttaacttaagaagtaatcatttaacttatctagacaaagatacatttaaaagcaatgctcaattaagagaactctacttatcaagtaactttattcactctcttgaaggaggactattccagtcgcttcatcacctggagcaacttgatctttccaagaatcgtattggccgactttgtgataacccatttgaaggattgtctcgtctgacttcattaggtttcgcagaaaatagtcttgaggagatacctgaaaaagcgctagagcctctaacatcacttaattttatcgacttatctcaaaataatttagcactactgccaaaaacaatagaaaaattgcgcgccttaagcactattgtggcaagtagaaatcatattactcgtattgataatatttcatttaaaaatcttcctaaattatctgtactcgatttatcaactaatgaaatttcaaatcttccaaatggtatatttaaacagaataaccaattaacaaaacttgattttttcaataacttgcttactcaggttgaagaatcagtatttccagatgttgaaacgcttaatttagatgtgaagttcaatcagataaaaagtgtgagtccaaaagtaagagctcttatcggacaacacaaactgactccacaaaaacatattgcaaaacttgaagcttccttagatggcgaaaaaataaaatatcatcaagctttcagtcttttagatttgtattattgggagcaaaaaacaaattctgccattgataaagaactagtgtctgttgaagaatatcaacaattgttacaagaaaaaggttcagatacggtttctttacttaatgatatgcaagtcgattggagtattgtgattcagttgcaaaaaaaagcttccaatggacagtatgtgacggttgacgaaaagcttctctcaaatgatccgaaagatgacttaacgggagagttttctttaaaagatccaggtacatatcggattcgcaaagctttaataacaaagaaatttgctactcaaaaagaacatatctatttgacatctaatgatatccttgtggcgaaaggaccacattcacatcagaaagatttagttgagaacggccttagagcattaaatcaaaaacaattgcgtgatggtatttactatttaaatgccagcatgttaaaaactgacttagcatctgagtccatgtcaaacaaggctattaatcatcgagtgactttggtagttaaaaaaggtgtttcctatttagaagttgagtttagaggtataaaggttggtaaaatgttaggctaccttggtgaattgagctatttcgtagatggttaccaaagagatttagctggtaaaccagttggtcgaacaaaaaaggcagaggttgtgtcttatttcacggatgtaactggcctaccattggcagatcgttatggaaaaaactatccaaaagtgctgcgtatgaaattgattgaacaagcgaagaaagacggacttgtgccattacaggtctttgtgcctatcatggatgccatttcaaaagggtctggccttcaaaccgtttttatgcgtttagactgggcaagccttacaacagagaaggcaaaggttgtcaaagaaactaataatccacaagaaaatagccatctaacttcaacagatcagttgaaaggacctcaaaatcgtcaacaagaaaaaacacctacaagtcctccttcagcagctactggtattgctaacttaactgatctcctggctaaaaaagcaaccggccaatcaactcaagaaacttctaagacagatgatactgataaggcagagaaattgaagcagttagtgcgtgaccatcaaacatcaattgaaggtaaaacagcaaaagatactaagactaaaaaatctgataagaaacatcgttccaatcaacaatcaaatggtgaagaaagtagctctcgttatcacttaattgcaggtctatctagctttatgatcgtagctctgggattcattattggtcgaaagacattatttaaataa

SEQ ID NO: 74 - DNA, 1512 bp, Streptococcus pyogenes
atgaataaaaacaaactattaagagttgccatgctactaagtctcttagccccgacagcagaaagcatgacagtgctggctcaagatgtaatgcttgagacgcataaagcaactacaaatgaaaccagtgattcttcttcaaaagaggaaaataataaaaatgcagcacctacaacatcagataaaactgaccaaggtccccttgatgcttctgcagaaacaaactctaatagtcttgttaacgcggatgataaaaaaagaagcgattctagtcagtctgctataggctcttcggacaacaaggcagaagcagaaaaccaggtagatgataaatcaactgatcattcgaaatcaactgatcattcgaaaccaactgaccagcccaaaccatcaccatctaaagttgatacggcacctgcttcttcattgtcgaaacaactgccagaggcaagaactcctattcagtcgttgtccccttacgtatcagatttagatttgagtgagatagatatcccttctgtcaacacatacgcggcatatgtagagcattggagtggtaaaaatgcctatacccaccatcttttatctcgccgttatggtattaaagctgaccagattgatagttacttaaaatcaacaggcattgcctatgacagcacacgtattaatggtgagaagctattgcaatgggaaaagaaaagtgggctggatgttcgagctatcgtagctattgcgatgtctgagagttctttaggaactcaagggattgcaactttgcttggagctaatatgtttggctatgcagcttttgatctagatccgactcaagcaagtaagtttaatgatgatagtgctattgtcaaaatgacacaagacaccattattaaaaacaaaaatagcaattttgcacttcaagatttaaaagcggctaagttttcacgaggtcaattaaactttgcaagtgacgggggtgtttattttactgatactactggtagtggtaaacgtcgcgcacaaattatggaagacctggataagtggattgatgaccatggtggcacaccagccattccagccgaattgaaagtgcagtcatcagctagttttgcatctgtgccagcaggttataagctctctaagagttatgatgtcttgggttatcaagcttcgagttatgcttggggacaatgcacttggtatgtgtataatcgcgccaaagaattgggttaccaatttgatccttttatgggaaatggtggagattggaagtataaagtagggtatgccctttcaaagactccaaaagtaggttatgctatttcatttgcaccagggcaagcgggcgctgatggcacttatggccacgtatcaattgtagaagatgttagaaaagatgggtctattcttatttcagagtctaactgtatcggcttaggtaagatttcttatcgtacctttacagctcagcaggctgaacagctaacatatgttattggcaagagtaaaaactaa

SEQ ID NO: 75 - DNA, 2988 bp, Streptococcus pyogenes
atggataaacatttgttggtaaaaagaacactagggtgtgtttgtgctgcaacgttgatgggagctgccttagcgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 76 - DNA, 558 bp, Streptococcus pyogenes
atgattgaagcaagtaagcttaaagcaggtatgacatttgaagcagaaggaaaattaatccgtgtccttgaagctagccaccacaaaccaggtaaaggaaacactatcatgcgtatgaaactacgtgatgtgcgtacaggttctacttttgacacaacttaccgcccagatgaaaaatttgagcaagccatcattgaaactgtcccagcacaatacctatacaaaatggatgacactgcttacttcatgaacactgacacttatgatcagtacgaaattccagttgctaacgttgagcaagaattgctttacattcttgaaaactcagacgtgaaaatccaattttatggaagtgaagtgattggggtaacggttccaacaactgttgaattgaccgttgcggaaacacaaccatctattaaaggagcgacagtgacgggttcagggaaacctgcaactcttgagacaggacttgttgttaacgttccagactttatcgaagctggccaaaaactaatcattaacactgcagaaggtacttacgtttctcgtgcttaa

SEQ ID NO: 77 - DNA, 1407 bp, Streptococcus pyogenes
atgactaaaacattacctaaagattttatttttggtggtgctacagctgcttaccaggctgaaggcgctacccacacagatggtaaaggaccagtagcttgggataaatacttagaagacaactattggtacacagctgagccagcaagtgatttttataatcgttaccctgtcgatttgaaacttagtgaagaatttggtgtcaacggcatccgtatctctattgcctggtctcgtatttttccaacaggaaaaggagaagttaaccctaaaggagtagaatactaccacaatctttttgcagagtgtcataagcgtcatgttgagccttttgttacacttcaccattttgataccccagaagctctccactcggatggtgacttcctcaatcgtgagaacattgaacattttgtaaattatgcagaattttgttttaaagaattctcagaagttaactattggacaacatttaacgaaattgggcctattggtgatggccaatacttagttggtaaattccctccaggtatccaatatgatcttgctaaagttttccaatcacaccataacatgatggtctctcatgctcgtgcagtcaaactctttaaagatagtggttattcaggtgaaattggtgttgtccatgcacttccaactaagtatccatttgacgctaacaatcctgatgatgttagagcagctgaacttgaagatatcatccataataaatttatccttgatgctacttatcttggtaagtattcagataaaacaatggaaggtgttaaccatatccttgaggtgaatggcggtgaacttgatcttcgcgaagaagattttgccgcactagacgccgcaaaagatttgaatgatttccttggtattaactactatatgagtgattggatgcaagcttttgatggtgagactgaaatcattcacaatggcaagggtgaaaaaggcagctctaaataccaaatcaagggtgttggtcgaagaaaagcacccgttgatgttccaaaaacggactgggactggattatcttcccacaaggcttatatgatcaaatcatgcgtgtcaaagccgattatcctaattacaagaaaatttacattacagagaatggtcttggctacaaagatgagtttgtagataatactgtctatgatggtggacgtatcgattatgtgaaaaaacacttagaagttatttctgatgctatttctgatggtgcaaatgttaaaggatactttatgtggtcactgatggatgtcttttcatggtcaaatggctatgaaaaacgttacggtctcttctatgttgattttgaaactcaagaacgttatcctaagaagagtgcctactggtataaaaaagtagcagaaactcaagtgattgaatga

SEQ ID NO: 78 - DNA, 3498 bp, Streptococcus pyogenes
atgaaaaagaaagtcaaccaaggatcaaagcgctatcaatatctgttaaaaaagtgggggataggttttgtaatcgctgcaactgggactgtcgtgttagggtgcacccctagtatcttaacacatcaagttgctgctaaaaccattgttggactagcccgcgatgaagctcaacaaggagatggcaatgctaaatctggtgatggtcttcaatcgtctagcaaggaggcaaaaccagttttagacagctcgtcagctaatcctgctagtattgctgagcatcatttgcgtatgcattttaaaacattgccagctggtgagtcgctaggaagcttgggactttgggtgtggggagatgtggatcaaccttcaaaggattggccaaatggtgctatcaccatgacaaaagcgaaaaaagatgactatggctattatctagatgtgccactagcagctaaacaccgccagcaagtgtcttatctcattaataataaagctggagagaatctttcaaaggaccagcacatctcgcttctcacgccaaaaatgaatgaagtttggatagacgagaattaccatgcgcacgcttatcgacctttgaaaaaaggttaccttcgaatcaactaccacaatcaatcgggacactacgataacttagctgtctggacctttaaagatgtcaaaaccccaacgaccgactggccaaatggacttgacttgtcacataaagggcattatggagcttatgttgatgtccccttaaaagaaggagctaacgaaatcggatttttaatccttgataaaagtaagacaggagatgctattaaagtgcaaccaaaagattatctatttaaagagttagacaatcatactcaggtttttgtcaaagacactgacccaaaagtttacaacaatccttattatattgatcaggttagtctcaaaggagctgaacaaaccacgccaaatgagattaaagccatttttacgaccttagatgggcttgatgaagatgcggtgaaacaaaacatcaagatcactgacaaagcagggaaaactgttgcaattgatgagttgacacttgacagggataagtctgtaatgacattaaagggtgattttaaggcgcaaggtgcagtctacacggttacatttggagaagttagccaagtcgctcgccaatcctggcaattaaaagataaactctatgcttacgatggtgaacttggagctaccctagctaaggatggttctgttgatttagcgctatggtctccaagtgctgatactgttaaggttgtcgtttatgataaacaagatcagacaagggtggttggtcaagctgatttgaccaagtcggacaagggtgtttggagagctcatctaacttctgacagtgtcaagggcattagtgattacacaggctactattacctttatgaaatcacgcgcggtcaggaaaaagtcatggttttggatccttacgccaaatctctcgctgcctggaatgatgcgactgctactgatgacatcaaaacagcaaaagctgcctttattgatccaagcaaactaggaccaacaggccttgattttgccaaaattaacaactttaaaaagcgtgaagacgctattatctatgaagcacatgtgcgagattttacgtcagataaggctctagaaggcaagttaacacacccttttgggactttttcagctttcgttgaacagctagactatctcaaagacttgggggttacccacgttcaattgctaccggttttgagttatttttatgccaatgagctggacaagagccgctcaacagcctacacgtcttcagacaataattacaactggggttatgacccacaacactactttgccctttctggcatgtattcggcaaatcctaatgaccctgctttacgtatcgcagagcttaaaaaccttgtcaatgagattcacaaacgtggtatgggtgttatttttgatgtggtttataaccacacggctagaacctatctctttgaagatttggaacccaactactatcattttatgaatgctgatggtacagctagagagagttttggcggaggtcgtctaggaacgacacatgccatgagtcgtcgtatcttggtggattcgattacttatctgactcgtgaattcaaggtagatggttttcgtttcgacatgatgggtgaccatgatgcggcagctattgagcaagcctttaaggcagccaaagccattaatccaaataccattatgattggcgaaggctggcgtacctaccaaggtgatgaggggaaaaaagaaattgcggcagatcaagattggatgaaagcaaccaatacggtcggtgttttctctgatgatatcagaaataccctcaagtcaggttttccaaatgaaggcacagcagcctttattactggtggcgcaaaaaatctagaaggtttattcaaaacgatcaaagcacagcctggtaactttgaagcagatgccccaggagatgtagtgcagtatattgcagcccatgacaacctgaccttacatgatgtcattgccaaatccatcaataaggatcctaaagtggctgaagaagagattcacaagcgtattcgtctaggaaataccatgattttaactgctcaagggactgcctttatccattctggtcaggaatatggacgaaccaagcagcttctaaatcccgactacaagacaaaggcgtctgatgacaaggtgccaaataaggcgactctgattgatgctgtagcgcaatacccttacttcatccacgattcttatgattcgtctgatgcggtcaatcattttgactgggcaaaggcaacagattccatagctcacccgattagcaaccaaacaaaagcctatacacagggactaattgcgttgcgtcgctcaacagatgcctttacaaaagcaaccaaagctgaggtagatcgggatgtgaccttgatcacccaagcaggacaagatggtattcaacaagaggacctcatcatgggttaccaaacagtggcatcaaatggagatcgctatgctgtctttgtcaatgcagacaacaagacccgcaaggtagttttacctcaagcctaccgctatttgctaggagcccaagtgcttgttgatgctgagcaagctggtgttactgccattgctaagcctaagggagtccagtttaccaaagaaggcttgactattgaaggcctaactgccctggtcctcaaagtatcctcaaaaacggctaatccctctcagcaaaagagtcagacagacaatcatcaaaccaaaacaccagatggctcaaaagacctagacaaatcattaatgactagaccaaaaagagctaaaacaaaccaaaagctcccaaaaacgggtgaagcctcctcaaaaggcttattagcagctggaatagctctgcttttattggctattagcctgttgatgaagcgccaaaaagattag

SEQ ID NO: 79 - DNA, 1323 bp, Streptococcus pyogenes
atgaaaaattacttatctattggagtgattgcactgctgtttgcattaacatttggaacagtcaagtcggtccaagctattgctgggtatggatggctaccagaccgtccacctatcaataacagccagttagttgttagtatggccggtatcgttgaaggtaccgataaaaaagtttttataaatttttttgaaatcgatctaacatcacaacctgctcacggaggaaagacagagcagggcttaagtccaaaatcaaaaccatttgctacagataatggcgcaatgccacataaacttgaaaaagctgacttattaaaagctattcaaaaacagctgatcgctaacgttcacagtaacgacggctactttgaggtcattgattttgcaagcgatgcaaccattactgatcgaaacggcaaggtctactttgctgacaaagatggttcggtaaccttgccgacccaacctgtccaagaatttttgttaaagggacatgtgcgcgttagaccatataaagaaaaaccagtacaaaatcaagcaaaatctgttgatgtagaatatactgtacagtttactcctttaaaccctgatgacgatttcagaccagggctcaaagatactaagctattgaaaacactagctatcggtgacaccatcacatctcaagaattactagctcaagcacaaagcattttaaacaaaacccacccaggctatacgatttatgaacgtgactcctcaatcgtcactcatgacaatgacattttccgtacgattttaccaatggatcaagagtttacttaccatgtcaaaaatcgggaacaagcttatgagatcaatcctaaaacaggtattaaagaaaaaacgaacaacactgatctggtctctgagaaatattacgtccttaaacaaggggaaaagccgtatgatccctttgatcgcagtcacttgaaactgttcaccatcaaatacgttgatgtcaacaccaacgaattgctaaaaagcgagcagctcttaacagctagcgaacgtaacttagacttcagagatttatacgatcctcgtgataaggctaaactactctacaacaatctcgatgcttttgatatcatggactataccttaactggaaaagtagaggataatcacgataagaataatcgtgtcgttacagtttatatgggcaagcgccctaaaggggcaaagggtagctatcatttagcttatgataaagatctctataccgaagaagaacgaaaagcttacagctacctgcgtgatacagggacacctatacctgataaccctaaagacaaataa

SEQ ID NO: 80 - DNA, 1047 bp, Streptococcus pyogenes
atgttgacatcaaagcaccataatctcaacaaactagtctggcgctacgggctaacctcagccgctgccgtccttctagcctttggaggcggggcaagcagcgttaaggctgaggtttcttctacgactatgacgtcgagtcaaagagagtcaaaaataaaagagatcgaagaaagtcttaaaaaatatccagaagtgtccaatgagaaattttgggaaagaaagtggtatggaacctattttaaagaagaagattttcaaaaggagctaaaagattttactgagaagaggcttaaggagattctagatttaattggtaaatctggaatcaagggagaccgtggtgagactggtcctgctggcccagccggaccacaaggtaaaactggtgagaggggcgcccaaggtcctaaaggtgaccgcggtgagcaaggaatccaaggtaaagctggtgaaaaaggtgagcgcggtgaaaaaggcgacaaaggtgaaaccggtgaacgcggtgaaaaaggcgaagctggaatccaaggcccacaaggtgaagctggtaaagatggcgctccaggtaaagatggagctccaggcgaaaagggtgaaaaaggtgaccgcggtgaaaccggagctcagggtccagtaggcccacaaggtgaaaaaggtgaaacgggcgcccaaggcccagcaggcccacaaggtgaggcaggcaaaccaggtgagcaaggcccagcaggcccacaaggtgaagcaggccaaccaggcgaaaaagctccagaaaagagcccagaaggcgaagcaggccaaccaggcgaaaaagctccagaaaagagcaaagaggtaactccagctgcagaaaaacctgctgacaaagaagctaaccaaacgccagaacgccgcaatggcaatatggctaagacacctgtagccaacaaccacagacgtctaccagcaactggtgagcaagccaacccattctttacagcagcagcagtagcagtgatgacaacagctggtgtcctagccgttacaaaacgcaaagaaaacaactaa

SEQ ID NO: 81 - DNA, 567 bp, Streptococcus pyogenes
atgatactcttaattgataattacgattcatttacctacaacctcgcccaatatttaagtgaatttgacgagacgattgtcttgtataaccaagacccaaacttatatgacatggccaaaaaagctaacgctctagtcctctcacctggtcctggttggcccaaggaagccaaccaaatgccaaaactcattcaagacttttaccaaacaaaacctatcttaggagtgtgtctgggacaccaagctatcgctgaaactttagggggaaccttacgcttggccaaacgcgtcatgcatgggagacaaagcaccattgaaacgcaaggccctgctagtctttttcgctccctgccacaagagatcaccgtcatgcgctaccattccatcgttgtggatcagttaccaaaaggttttagcgtaaccgctagagactgtgacgatcaagaaatcatggcatttgaacaccacaccctgccactttttgggctacaatttcacccagaaagcatcggaactcctgatggcatgaccatgattgccaacttcatcgcagccattccccgttaa

SEQ ID NO: 82 - DNA, 1629 bp, Streptococcus pyogenes
gtgtcaaaatacctaaaatacttctctattatcacgttatttttgactgggcttattttagttgcatgtcaacaacaaaagcctcaaacaaaagaacgtcagcgcaaacaacgtccaaaagacgaacttgtcgtttctatgggggcaaagctccctcatgaattcgatccaaaggaccgttatggagtccacaatgaagggaatatcactcatagcactctattgaaacgttctcctgaactagatataaaaggagagcttgctaaaacataccatctctctgaagatgggctgacttggtcgtttgacttgcatgatgattttaaattctcaaatggtgagcctgttactgctgatgatgttaagtttacttatgatatgttgaaagcagatggaaaggcttgggatctaaccttcattaagaacgttgaagtagttgggaaaaatcaggtcaatatccatttgactgaggcgcattcgacatttacagcacagttgactgaaatcccaatcgtccctaaaaaacattacaatgataagtataagagcaatcctatcggttcaggaccttacatggtaaaagaatataaggctggagaacaagctatttttgttcgtaacccttattggcatgggaaaaaaccatactttaaaaaatggacttgggtcttacttgatgaaaacacagcactagcagctttagaatctggtgatgttgatatgatctacgcaacgccagaacttgctgataaaaaagtcaaaggcacccgcctccttgatattccatcaaatgatgtgcgcggcttatcattaccttatgtgaaaaagggcgtcatcactgattctcctgatggttatcctgtaggaaatgatgtcactagtgatccagcaatccgaaaagccttgactattggtttaaataggcaaaaagttctcgatacggttttaaatggttatggtaaaccagcttattcaattattgataaaacaccattttggaatccaaaaacagccattaaagataataaagtagctaaagctaagcaattattgacaaaagcgggatggaaagaacaagcagacggtagccgtaaaaaaggtgaccttgatgcagcgtttgatctgtactaccctactaatgatcaattgcgagcgaacttagccgttgaagtagcagagcaagccaaggccctagggattactattaaactcaaagctagtaactgggatgaaatggcaacgaagtcacatgactcagccttactttatgccggaggacgtcatcacgcgcagcaattttatgaatcgcatcatccaagcctagcagggaaaggttggaccaatattacgttttataacaatcctaccgtgactaagtaccttgacaaagcaatgacatcttctgaccttgataaagctaacgaatattggaagttagcgcagtgggatggcaaaacaggtgcttctactcttggagatttgccaaatgtatggttggtgagccttaaccatacttatattggtgataaacgtatcaatgtaggtaaacaaggcgtccacagtcatggtcatgattggtcattattgactaacattgccgagtggacttgggatgaatcaactaagtaa

SEQ ID NO: 83 - DNA, 2478 bp, Streptococcus pyogenes
gtgaagaaaacatatggttatatcggctcagttgctgctattttactagctactcatattggaagttaccaacttggtaagcatcatatgggttcagcaacaaaggacaatcaaattgcctatattgatgatagcaaaggtaaggcaaaagcccctaaaacaaacaaaacgatggatcaaatcagtgctgaagaaggcatctctgctgaacagatcgtagtcaaaattactgaccaaggctatgtgacctcacatggtgaccattatcatttttacaatgggaaagttccttatgatgcgattattagtgaagagttgttgatgacggatcctaattaccgttttaaacaatcagacgttatcaatgaaatcttagacggttacgttattaaagtcaatggcaactattatgtttacctcaagccaggtagcaagcgcaaaaacattcgaaccaaacaacaaattgctgagcaagtagccaaaggaactaaagaagctaaagaaaaaggtttagctcaagtggcccatctcagtaaagaagaagttgcggcagtcaatgaagcaaaaagacaaggacgctatactacagacgatggctatatttttagtccgacagatatcattgatgatttaggagatgcttatttagtacctcatggtaatcactatcattatattcctaaaaaggatttgtctccaagtgagctagctgctgcacaagcctactggagtcaaaaacaaggtcgaggtgctagaccgtctgattaccgcccgacaccagccccagccccaggtcgtaggaaagccccaattcctgatgtgacgcctaaccctggacaaggtcatcagccagataacggtggctatcatccagcgcctcctaggccaaatgatgcgtcacaaaacaaacaccaaagagatgagtttaaaggaaaaacctttaaggaacttttagatcaactacaccgtcttgatttgaaataccgtcatgtggaagaagatgggttgatttttgaaccgactcaagtgatcaaatcaaacgcttttgggtatgtggtgcctcatggagatcattatcatattatcccaagaagtcagttatcacctcttgaaatggaattagcagatcgatacttagccggccaaactgaggacgatgactcaggttcagatcactcaaaaccatcagataaagaagtgacacatacctttcttggtcatcgcatcaaagcttacggaaaaggcttagatggtaaaccatatgatacgagtgatgcttatgtttttagtaaagaatccattcattcagtggataaatcaggagttacagctaaacacggagatcatttccactatataggatttggagaacttgaacaatatgagttggatgaggtcgctaactgggtgaaagcaaaaggtcaagctgatgagcttgctgctgctttggatcaggaacaaggcaaagaaaaaccactctttgacactaaaaaagtgagtcgcaaagtaacaaaagatggtaaagtgggctatatgatgccaaaagatggcaaggactatttctatgctcgtgatcaacttgatttgactcagattgcctttgccgaacaagaactaatgcttaaagataagaaacattaccgttatgacattgttgacacaggtattgagccacgacttgctgtagatgtgtcaagtctgccgatgcatgctggtaatgctacttacgatactggaagttcgtttgttatccctcatattgatcatatccatgtcgttccgtattcatggttgacgcgcgatcagattgcaacaatcaagtatgtgatgcaacaccccgaagttcgtccggatatatggtctaagccagggcatgaagagtcaggttcggtcattccaaatgttacgcctcttgataaacgtgctggtatgccaaactggcaaattatccattctgctgaagaagttcaaaaagccctagcagaaggtcgttttgcaacaccagacggctatattttcgatccacgagatgttttggccaaagaaacttttgtatggaaagatggctcctttagcatcccaagagcagatggcagttcattgagaaccattaataaatctgatctatcccaagctgagtggcaacaagctcaagagttattggcaaagaaaaacgctggtgatgctactgatacggataaacccaaagaaaagcaacaggcagataagagcaatgaaaaccaacagccaagtgaagccagtaaagaagaagaaaaagaatcagatgactttatagacagtttaccagactatggtctagatagagcaaccctagaagatcatatcaatcaattagcacaaaaagctaatatcgatcctaagtatctcattttccaaccagaaggtgtccaattttataataaaaatggtgaattggtaacttatgatatcaagacacttcaacaaataaacccttaa

SEQ ID NO: 84 - DNA, 1140 bp, Streptococcus pyogenes
atgcgtagagcagaaaataacaaacacagccgctattccattcgcaaactgagcgttggggtaacgagtatagcaattgcgagtctctttttaggaaaggttgcctatgccgtagatggcatccctccaatctctcttactcaaaagactacagccactacatcagaaaattggcatcatattgataaggatggccttattcctttaggtataagcttagaagctgccaaagaggaatttaaaaaagaagtagaagaatcacgtttatctgaagcacaaaaagaaacgtataaacaaaaaattaaaactgcaccagacaaagataagctattattcacgtatcatagtgagtatatgacagccgttaaggatcttccagcgtctactgagtctactactcagccagttgaggcacccgtgcaggagacacaggcatcagcttcagattcgatggtgacaggtgattcaacatcagttacgactgattctcctgaggaaaccccatcttcggaaagtccagtggccccagctttatctgaggctccagctcaaccagctgagagtgaggaaccttcagtagcagcatcttctgaggaaaccccatctccatcaactccagcggccccagaaactcctgaagaaccagcagctccatctccatcacctgagagtgaggaaccttcagtagcagctccttctgaggaaaccccatctccagaaactcctgaagaaccagcagctccatctcaaccagctgagagtgaagaatcttcagtagcagctacgacaagcccgtctccatcaactccagctgaatcagagactcagacgccaccagctgttactaaagactctgataagccatcttcagcagctgaaaaaccagcagcctcttcacttgtttcagaacaaaccgttcaacaaccaacttcaaagagatcttctgataaaaaagaagagcaagaacagtcttactctccaaatcgctcattgtcaagacaggttagggcccatgagtcaggtaagtacttgccttcaacaggtgaaaaagcacagccactctttatagctactatgactttgatgtctctatttggcagtcttttagtcacaaaacgccaaaaagaaactaaaaaatag

SEQ ID NO: 85 - DNA, 3546 bp, Streptococcus pyogenes
ttgcgtaaaaaacaaaaattaccatttgataaacttgccattgcgctcatgtctacgagcatcttgctcaatgcacaatcagacattaaagcaaatactgtgacagaagacactcctgctaccgaacaagctgtagaaaccccacaaccaacagcggtttctgaggaagcaccatcatcaaaggaaaccaaaaccccacaaactcctgatgacgcagaagaaacaatagcagatgacgctaatgatctagcccctcaagctcctgctaaaactgctgatacaccagcaacctcaaaagcgactattagggatttgaacgacccttctcaggtcaaaaccctgcaggaaaaagcaggcaaaggagctgggactgttgttgcagtgattgatgctggttttgataaaaatcatgaagcgtggcgcttaacagacaaaaccaaagcacgttaccaatcaaaagaagatcttgaaaaagctaaaaaagagcacggtattacctatggcgagtgggtcaatgataaggttgcttattaccacgactatagtaaagatggtaaaaccgctgtcgatcaagagcacggcacacacgtgtcagggatcttgtcaggaaatgctccatctgaaacgaaagaaccttaccgcctagaaggtgcgatgcctgaggctcaattgcttttgatgcgtgtcgaaattgtaaatggactagcagactatgctcgtaactacgctcaagctatcatagatgctgtcaacttgggagctaaggtgattaatatgagctttggtaatgctgcactagcctatgccaaccttccagacgaaaccaaaaaagcctttgactatgccaaatcaaaaggtgttagcattgtgacctcagctggtaatgatagtagctttgggggcaagacccgtctacctctagcagatcatcctgattatggggtggttgggacacctgcagcggcagactcaacattgacagttgcttcttacagcccagataaacagctcactgaaactgctacggtcaaaacagccgatcagcaagataaagaaatgcctgttctttcaacaaaccgttttgagccaaacaaggcttacgactatgcttatgctaatcgtgggatgaaagaggatgattttaaggatgtcaaaggtaagattgcccttattgaacgtggcgatattgatttcaaagataagattgcaaacgctaaaaaagctggtgctgtaggagtcttgatctatgacaatcaggacaagggcttcccgattgaattgccaaatgttgatcagatgcctgcggcctttatcagtcgaaaagatggtctcttattaaaagagaatccccaaaaaaccatcaccttcaatgcgacacctaaggtattgccaacagcaagtggcaccaaactaagccgcttctcaagctggggtctgacagctgacggcaatattaagccagatattgcagcacccggccaagatattttgtcatcagtggctaacaacaagtatgccaaactttctggaactagtatgtctgcgccattagtagcgggtatcatgggactgttgcaaaagcaatatgagacacagtatcctgatatgacaccatcagagcgtcttgatttagctaaaaaagtattgatgagctcagcaactgccttatatgatgaagatgaaaaagcttatttttctcctcgccaacaaggagcaggagcagtcgatgctaaaaaagcttcagcagcaacgatgtatgtgacagataaggataatacctcaagcaaggttcacctgaacaatgtttctgataaatttgaagtaacagtaacagttcacaacaaatctgataaacctcaagagttgtattaccaagcaactgttcaaacagataaagtagatggaaaactctttgccttggctcctaaagcattgtatgagacatcatggcaaaaaatcacaattccagccaatagcagcaaacaagtcaccattccaatcgatgttagtcaatttagcaaggacttgcttgccccaatgaaaaatggctatttcttagaaggttttgttcgtttcaaacaagatcctacaaaagaagagcttatgagtattccctatattggtttccgaggtgattttggcaatctgtcagccttagaaaaaccaatctatgatagcaaagacggtagcagctactatcatgaagcaaatagtgatgccaaagaccaattagatggtgatggattacagttttacgctctgaaaaataactttacagcacttactacagagtctaatccatggacgattattaaagctgtcaaagaaggggttgaaaacatagaggatatcgaatcttcagagatcacagaaaccatttttgcaggtacttttgcaaaacaagacgatgatagccactactatatccaccgtcacgctaatggcaagccatatgctgcgatctctccaaatggggacggtaacagagattatgtccaattccaaggtactttcttgcgtaatgctaaaaaccttgtggctgaagtcttggacaaagaaggaaatgttgtttggacaagtgaggtaaccgagcaagttgttaaaaactacaacaatgacttggcaagcacacttggttcaacccgttttgaaaaaacgcgttgggacggtaaagataaagacggcaaagttgttgctaacggaacatacacctatcgtgttcgctacactccgattagctcaggtgcaaaagaacaacacactgattttgatgtgattgtagacaatacgacacctgaagtcgcaacatcggcaacattctcaacagaagatcgtcgtttgacacttgcatctaaaccaaaaaccagccaaccggtttaccgtgagcgtattgcttacacttatatggatgaggatctgccaacaacagagtatatttctccaaatgaagatggtacctttactcttcctgaagaggctgaaacaatggaaggcgctactgttccattgaaaatgtcagactttacttatgttgttgaagatatggctggtaacatcacttatacaccagtgactaagctattggaaggccactctaataaaccagaacaagacggttcagatcaagcaccagacaaaaaaccagaaactaaaccagaacaagacggttcaggtcaagcaccagataaaaaaccagaaactaaaccagaacaagacggttcaggtcaaacaccagacaaaaaaccagaaactaaaccagaacaagacggttcaggtcaaacaccagataaaaaaccagaaactaaaccagaaaaagatagttcaggtcaaacaccaggtaaaactcctcaaaaaggtcaaccttctcgtactctagagaaacgatcttctaagcgtgctttagctacaaaagcatcaacaaaagatcagttaccaacgactaatgacaaggatacaaatcgtttacatctccttaagttagttatgaccactttcttcttgggattagtagctcatatctttaaaacaaaacgcactgaagattag

SEQ ID NO: 86 - DNA, 927 bp, Streptococcus pyogenes
atgaatattagaaataagattgaaaatagtaaaacactactatttacatcccttgtagccgtggctctactaggagctacacaaccagtttcagccgaaacgtatacatcacgcaattttgactggtctggagatgactggtctggagatgactggcctgaagatgactggtctggagatggtttgtctaaatatgaccggtctggagttggtttgtctcaatatggctggtctaaatatggctggtctagcgataaagaagaatggcctgaagattggcctgaagatgactggtctagcgataaaaaagatgagacagaagataaaacgagaccaccatatggagaagcattaggtacagggtatgaaaaacgtgatgattggggaggacctggtacggtggcaactgacccttacactccaccatatggaggagcattaggtacagggtatgaaaaacgtgatgattggggaggacctggtacggtggcaactgacccttacactccaccatatggaggagcattaggtacagggtatgaaaaacgtgatgattggagaggacctggacatattcctaaacctgagaacgaacaatcaccaaacccacttcatattcctgaacctcctcagattgagtggcctcagtggaatggctttgatggattatcatttggcccctctgattggggccaatctgaggacacccctccaagtgaacctcgtgtgccagaaaaaccgcaacatactcctcaaaaaaatccacaagaatcagattttgatagagggttttcagctggcttgaaagcaaaaaactcaggtagaggtattgattttgaaggtttccagtatggtggctggtcagacgaatataaaaaaggttacatgcaagccttcggtacaccatatacaccatcagcaacgtaa

SEQ ID NO: 87 - DNA, 1455 bp, Streptococcus pyogenes
atggctaaaaataacacgaatagacactattcgcttagaaaattaaaaacaggaacggcttcagtagcggtagctttgactgttttaggggcaggttttgcgaatcaaacagaggttaaggctaacggtgatggtaatcctagggaagttatagaagatcttgcagcaaacaatcccgcaatacaaaatatacgtttacgttacgaaaacaaggacttaaaagcgagattagagaatgcaatggaagttgcaggaagagattttaagagagctgaagaacttgaaaaagcaaaacaagccttagaagaccagcgtaaagatttagaaactaaattaaaagaactacaacaagactatgacttagcaaaggaatcaacaagttgggatagacaaagacttgaaaaagagttagaagagaaaaaggaagctcttgaattagcgatagaccaggcaagtcgggactaccatagagctaccgctttagaaaaagagttagaagagaaaaagaaagctcttgaattagcgatagaccaagcgagtcaggactataatagagctaacgtcttagaaaaagagttagaaacgattactagagaacaagagattaatcgtaatcttttaggcaatgcaaaacttgaacttgatcaactttcatctgaaaaagagcagctaacgatcgaaaaagcaaaacttgaggaagaaaaacaaatctcagacgcaagtcgtcaaagccttcgtcgtgacttggacgcatcacgtgaagctaagaaacaggttgaaaaagatttagcaaacttgactgctgaacttgataaggttaaagaagacaaacaaatctcagacgcaagccgtcaaggccttcgccgtgacttggacgcatcacgtgaagctaagaaacaggttgaaaaagatttagcaaacttgactgctgaacttgataaggttaaagaagaaaaacaaatctcagacgcaagccgtcaaggccttcgccgtgacttggacgcatcacgtgaagctaagaaacaagttgaaaaagctttagaagaagcaaacagcaaattagctgctcttgaaaaacttaacaaagagcttgaagaaagcaagaaattaacagaaaaagaaaaagctgaactacaagcaaaacttgaagcagaagcaaaagcactcaaagaacaattagcgaaacaagctgaagaacttgcaaaactaagagctggaaaagcatcagactcacaaacccctgatacaaaaccaggaaacaaagctgttccaggtaaaggtcaagcaccacaagcaggtacaaaacctaaccaaaacaaagcaccaatgaaggaaactaagagacagttaccatcaacaggtgaaacagctaacccattcttcacagcggcagcccttactgttatggcaacagctggagtagcagcagttgtaaaacgcaaagaagaaaactaa

SEQ ID NO: 88 - DNA, 1626 bp, Streptococcus pyogenes
atgaagaaaaggaaattgttagcagtaacactattaagtaccatactcttaaacagtgcagtgccattagttgttgctgatacctccttgcgtaatagcacatcatccactgatcagcctactacagcagatactgatacggatgacgagagtgaaacaccaaaaaaagacaaaaaaagcaaggaaacagcgtcgcagcacgacacccaaaaagaccataagccatcacacactcacccaacccccccttcaaatgatactaagcagaccgatcaggcatcatctgaagctactgacaaaccaaataaagacaaaaacgacaccaagcaaccagacagcagtgatcaatccaccccatctcccaaagaccagtcgtctcaaaaagagtcacaaaacaaagacggccgacctaccccatcacctgatcagcaaaaagatcagacacctgataaaacaccagaaaaatcagctgataaaacccctgaaaaaggaccagaaaaagcaactgataaaacaccagagccaaatcgtgacgctccaaaacccatccaacctcctttagcagctgctcctgtctttataccttggagagaaagtgacaaagacctgagcaagctaaaaccaagcagtcgctcatcagcggcttacgtgagacactggacaggtgactctgcctacactcacaacctgttgtcacgccgttatgggattactgctgaacagctagatggttttttgaacagtctaggtattcactatgataaagaacgcttaaacggaaagcgtttattagaatgggaaaaactaacaggactagacgttcgagctatcgtagctattgcaatggcagaaagctcactaggtactcagggagttgctaaagaaaaaggagccaatatgtttggttatggcgcctttgacttcaacccaaacaatgccaaaaaatacagcgatgaggttgctattcgtcacatggtagaagacaccatcattgccaacaaaaaccaaacctttgaaagacaagacctcaaagcaaaaaaatggtcactaggccagttggataccttgattgatggtggggtttactttacagatacaagtggcagtgggcaaagacgagcagatatcatgaccaaactagaccaatggatagatgatcatggaagcacacctgagattccagaacatctcaagataacttccgggacacaatttagcgaagtgcccgtaggttataaaagaagtcagccacaaaacgttttgacctacaagtcagagacctacagctttggccaatgcacttggtacgcctataatcgtgtcaaagagctaggttatcaagtcgacaggtacatgggtaacggtggcgactggcagcgcaagccaggttttgtgaccacccataaacctaaagtgggctatgtcgtctcatttgcaccaggccaagcaggagcagatgcaacctatggtcacgttgctgttgtagagcaaatcaaagaagatggttctatcttaatttcagagtcaaatgttatgggactaggcaccatttcctatcggacgttcacagctgagcaggctagtttgttgacctatgtcgtaggggacaaactcccaagaccataa

SEQ ID NO: 89 - DNA, 1197 bp, Streptococcus pyogenes
atgaataaaaagaaattaggtgtcagattattaagtcttttagcattaggtggatttgttcttgctaacccagtatttgccgatcaaaactttgctcgtaacgaaaaagaagcaaaagatagcgctatcacatttatccaaaaatcagcagctatcaaagcaggtgcacgaagcgcagaagatattaagcttgacaaagttaacttaggtggagaactttctggctctaatatgtatgtttacaatatttctactggaggatttgttatcgtttcaggagataaacgttctccagaaattctaggatactctaccagcggatcatttgacgctaacggtaaagaaaacattgcttccttcatggaaagttatgtcgaacaaatcaaagaaaacaaaaaattagacactacttatgctggtaccgctgagattaaacaaccagttgttaaatctctccttgattcaaaaggcattcattacaatcaaggtaacccttacaacctattgacacctgttattgaaaaagtaaaaccaggtgaacaatcttttgtaggtcaacatgcagctacaggatgtgttgctactgcaactgctcaaattatgaaatatcataattaccctaacaaagggttgaaagactacacttacacactaagctcaaataacccatatttcaaccatcctaagaacttgtttgcagctatctctactagacaatacaactggaacaacatcttacctacttatagcggaagagaatctaacgttcaaaaaatggcgatttcagaattgatggctgatgttggtatttcagtagacatggattatggtccatctagtggttctgcaggtagctctcgtgttcaaagagccttgaaagaaaactttggctacaaccaatctgttcaccaaatcaaccgtggcgactttagcaaacaagattgggaagcacaaattgacaaagaattatctcaaaaccaaccagtatactaccaaggtgtcggtaaagtaggcggacatgcctttgttatcgatggtgctgacggacgtaacttctaccatgttaactggggttggggtggagtctctgacggcttcttccgtcttgacgcactaaacccttcagctcttggtactggtggcggcgcaggcggcttcaacggttaccaaagtgctgttgtaggcatcaaaccttag

SEQ ID NO: 90 - DNA, 816 bp, Streptococcus pyogenes
atgaatctacttggatcaagacgggttttttctaaaaaatgtcggctagtaaaattttcaatggtagctcttgtatcagccacaatggctgtaacaacagtcacacttgaaaatactgcactggcacgacaaacacaggtctcaaatgatgttgttctaaatgatggcgcaagcaagtacctaaacgaagcattagcttggacattcaatgacagtcccaactattacaaaaccttaggtactagtcagatcactccagcactctttcctaaagcaggagatattctctatagcaaattagatgagttaggaaggacgcgtactgctagaggtacattgacttatgccaatgttgaaggtagctacggtgttagacaatctttcggtaaaaatcaaaaccccgcaggctggactggaaaccctaatcatgtcaaatataaaattgaatggttaaatggtctatcttatgtcggagatttctggaatagaagtcatctcattgcagatagtctcggtggagatgcactcagagtcaatgccgttacagggacacgtacccaaaatgtaggaggtcgtgaccaaaaaggcggcatgcgctataccgaacaaagagctcaagaatggttagaagcaaatcgtgatggctatctttattatgaagctgctccaatctataacgcagacgagttgattccaagagctgtcgtggtatcaatgcaatcttctgataataccatcaacgagaaagtattagtttacaacacagctaatggctacaccattaactaccataacggtacacctactcagaaataa

SEQ ID NO: 91 - DNA, 2337 bp, Streptococcus pyogenes
atgagatttctagaacttttacaaaagaaattttttcctaaagcatatcaggaaaaacaattcttaatgcatcaaaaaacgcgtttaacgccacaacacaatcaaaagcagtattcgccaaatgccaatcatttggactcatcagctaccaaaaactcagaacaagaccctgcaacagctctgcaacgcagtagagcctacgaaggaagccctaaaagtcggcccgcttggttgcaaaagctggaagctgttttgccgtctcctcaacgtccaattcggcgtttttggcgccgctatcacatcggaaaactgctaatgattctgattggaactcttgtcttactcttaggatcatacttgttttacttatcaaaaacagctaaagtatctgatttacaagatgccttgaaggctacaacggttatttatgatcacaaaggagagtatgcaggcagtttatctggtcaaaaagggagttatgttgagctcaacgctatttcagatgatcttgagaatgctgttattgccactgaggataggactttttacagtaatagcggtattaatcttaaacgcttcttattggcggtagttacggcgggccgctttggaggtggctcaacgattacacagcaactggctaaaaatgcttatctctcacaagatcagacaattaaacgaaaggcccgagagttttttttggcgttagagttgaccaaaaaatacagtaaaaaagatattcttactatgtaccttaacaactcctactttggaaatggagtttggggagttgaagatgccagtcaaaaatattttggaaccacagctgctaacttaacactggatgaagctgccacattagcaggtatgctcaaaggacctgaaatatataacccttaccattctctaaaaaatgctactcaccgtagagatactgttttaggagcgatggttgatgccaaaaagattacccaaacaaaagctcagcaagctagagcagtagggctaaaaaatcgcttagctgatacttatgttggtaagacagatgactacaaatacccatcctactttgatgctgttattagtgaagcaatagcaacttatggtctttcagaaaaagacattgttaataatggatacaaagtttacactgagctagatcaaaattaccaaactggcatgcagacgacttttaacaacgatgaactatttcctgtttcagcttatgacggtagctctgctcaagcagctagtgttgctttagatcctaaaacaggaggtgttagaggtctgattggtcgtgtgaatagtagtgaaaatccgactttcagaagttttaactatgcgactcaagcaaaacgtagtcccgcatcaacaatcaaaccactcgtggtttacgcgccagccgttgcttcaggatggtcaattgaaaaagaactaccaaataccgttcaagatttcgatggctatcagccacataattatggaaattatgaatcagaagatgttcctatgtatcaagcattagcaaactcttataatattccagcagtttctacattgaacgatatcggaatcgataaagcctttacctatggtaaaacatttgggttagatatgagctctgccaaaaaagagttgggggtagctttaggtggcagcgtgacaaccaatccattggagatggctcaggcatatgctgcctttgccaataatggagtaatccatcctgcgcacttgattaaccggattgaaaatgccaggggtgaagtgcttaaaacctttactgataaggctaaacgtgttgtcagccagtctgttgcagataagatgacagccatgatgctaggtaccttttcaaatggaacagcagtcaatgctaacgtatatggctatacactagctggtaaaacagggacgacagaaaccaacttcaatcccgacttagcaggcgatcagtgggttattggttatacgccagatgttgttattagtcaatgggtaggatttaatcagaccgatgaaaatcattatctaacggattcaagtgcaggcacggcctcagctatttttagcactcaggcatcttacattttgccttataccaagggcagccaatttcatgtagataatgcctacgctcaaaatggtatttcagctgtttatggagtcaatgaaacaggtaatcaatcaggagttgatactcaatctattattgatggtttaagaaaatcagcacaagaagcttcgcaatcactatcaaaagcagtcgatcagtcagggttacgtgataaagcccaatctatttggaaagagattgttgactattttagatag

SEQ ID NO: 92 - DNA, 2199 bp, Streptococcus pyogenes
atggtaagtttagaagaagacaaggtgactgttcaacctgatattaaagtgattaaacgagatggtcgccttgttaattttgatagtacaaaaatctatagtgctttattaaaagcaagcatgaaagtaactcggatgtcgccacttgttgaggctaaattagaggctatttctgatcgcattatagcagaaattattgagcgttttccaactaatatcaaaatttatgaaatccaaaatattgtagagcataagcttcttgcagctaatgaatatgctattgcaaaagaatacattaattatcgtactcagcgtgactttgcacgttcacaagcaacagatatcaatttttctattgataaattaattaataaagatcaaacagttgttaatgaaaatgctaacaaagatagcgatgtttttaatactcaacgagatttaactgctggaatcgtagggaaatcgattggtttaaaaatgttaccttcgcatgttgctaatgctcatcaaaaaggagatatccattaccatgatttggattacagtccttatacaccgatgacgaactgctgtttaattgactttaagggcatgttagccaatggctttaaaattggtaatgctgaagtggaaagtcccaagtctattcaaactgcaacagctcagatctcacagattattgcgaatgtagcatcaagtcagtacggcggatgcacagctgatcgcattgacgagtttttagccccatatgcggagcttaactttaaaaaacatatggctgatgctaagaaatggatcgttgagactaagagagaaagctatgcttttgaaaagactcaaaaagatatttatgatgcgatgcagtctttggagtatgaaattaatacgctctttacgtctaatggtcaaacaccatttacttctttaggatttggtttggggacgtcttggtttgaacgtgagattcaaaaagctattttgaccattcggattaatggtcttggtagtgaacatcgcacggctattttccctaaattaattttcacggttaaacgtggcttgaatttagaaccagattcaccaaactatgatattaagactttggctttagaatgtgcgactaagcggatgtacccggatatgttatcttatgataaaattattgatttgacaggatctttcaaatctccaatgggatgccgctctttccttcaaggctggaaagatgaaaatgggcaagatgtgacctcaggccgtatgaatcttggggttgtcaccctcaatttacctcgcattgccatggaatcaaatggcgatatggataagttttgggagctgtttaatgagaggatgctaattagtaaggatgctttaatttatcgtgtcgaacgtgtcacagaagcaaaaccagcaaatgctcctattctttatcaatatggtgcttttggaaagcgtttggagaagacagggaatgtaaatgatctctttaagaatcgtcgtgcaacagtctctcttggctatattggtctttatgaagtggcgtctgttttttatggtggtcaatgggaaggtaatccagatgctaaagcttttaccttgtcaattgtcaaggcaatgaaacaggcctgtgaggattggtcagatgaatatggttatcatttctctgtttattcgactccatcagaaagtttgacagatcgcttttgtcgtttagatacggaaaaatttggcattgtgacagatattacggataaagaatactatacaaattcttttcactatgatgtgcgtaagagtccgacaccttttgaaaaattagattttgaaaaagattatccagaagcaggtgcttcaggtggttttatccactactgtgagtatcctgttttgcaacaaaatccaaaggccttggaagcggtttgggactatgcttatgatcgtgtggggtatttgggaaccaatacgcctattgataaatgctataattgccaatttgaaggcgattttaccccaacagaacgtggttttacttgcccaaactgtggcaataatgaccctaaaacagttgatgtggtcaaacgtacatgtggttacttggggaatcctcaggcccgcccaatggttaacggtcgccataaggaaatctctgcgcgtgtaaaacatatgaatggttctactataaaatacccaggcctgtaa

SEQ ID NO: 93 - DNA, 768 bp, Streptococcus pyogenes
atgaggaggaattacagtagagtcattgacgaactgcgtactgactacgggctgaatttagttgctattggtcaacgtttgggtaccgacccccgaacagttggtaaatggtggcagggtaaacataacccgaaccaagaaagcagaaagaaactgaataggctatatagagaggtgaaagaaactatgatgacacaagtaaatatttttgaagaagctaatgacaacacaaagcaggttatgcaagttattacaacgacaaattttcatggacaacctttagacatttacggtgatattcaggagcctttatttttggctagggcagtcgctgaaatgattgattacacaaaaactagccaagggtactatgacgtacaagctatgctaagaaaagtagatgaggatgaaaagcttaaaggaatggctttagaaggtactacgaaaaattttcgtagtggtcaaaaagtttggtttttaactgagcatggactttatgaagtgcttatgcgttcaaacaaaccaaaagccaaagagtttagaaaagcagtcaaaaacattctaaaagaaatccgcttgaatggctattacatgcaaggcgaattggtgcaagaactagctcaaccaagcacccaaaaactaccaggtataagtgacctaacttatatactaaataagctagctgatttagttgatatggataatctagctgatatttcaaatgggattgaccgagttcagcaactagtgaagctgatcagcttgtag

SEQ ID NO: 94 - DNA, 615 bp, Streptococcus pyogenes
atgtttaagaaagaaaatttaaaacaacgttattttaattttggattagtagcgttagctctaacaatattagccatcatttttgccttctcaagtaaaaatgctgatactaagtcttatgctaagaagtcagaaagtaaaatggtaacaatcgacaaggctccaaaaaataatcatgctattactaaagaagaaagcaaagaaaaagcaaagagcattgcttcggagcctattcccacagtagaaaactctgtagctccgacagtaacagaggaagtaccggttgttcagcaagaagtgactcaaactgttcagcaggtatcttcagtagcctataatccaaacaatgtggtactttccaatggaaatactgctggtattgtaggaagtcaagcggcggcacagatggcagcagcaacaggtgttccacaatcaacttgggaacatataattgcgcgtgaatctaatggaaatcctaacgcagctaatgcttctggggcatcagggttgttccagacaatgccaggttggggttctacagcaacggttgaagatcaagtcaatgcagccttgaaagcctatagtgcacaaggtttatcagcttggggttactaa

SEQ ID NO: 95 - DNA, 2577 bp, Streptococcus pyogenes
atgaaaaataataataaatggataattgctggacttgctagttttttgttccctcttagtattatatttatcatccttctatcgatgggcatttattataatagtgataaaacaattctagctagtgatgcttttcatcagtatgttatttttgcgcagaactttcgtaacatcatgcacggttctgatagttttttttatacctttacaagcggactagggataaatttttatgctttaatgtgttattatcttggcagtttcttttctccattacttttcttttttaatttaacctctatgccagatgctatctatttgtttaccttgataaaatttgggttaataggattagctgcatgctattcttttcatagattatatccaaaaatcagtgctttcttgatgatttccatctcagttttttatagcttaatgagcttcttgacaagtcaaatggaactaaattcttggttagatgttttcattcttcttccacttgttatacttggattaaataaacttatcacagaaaataaaaccagaacttattatctttcgatatcattattattcattcaaaattactactttggctacatgattgctcttttttgtattctttacgccttagtttgtcttttacgtctcaatgattttaacaaaatgtttatcgcttttgttaggtttacagctgtgtcaatatgtgctgctttaacaagtgctctagtaatacttcctacctatctagatttgtcaacttatggagagaatctatccccgataaaacagttagttacgaacaatgcttggtttttggatatacctgctaagctctcaataggagtgtacgatactaccaagtttaatgctctgcctatgatttacgtaggattatttcccctaatgcttagtgttatttattttactttagaaagtatccctttaaaaataaaattagccaatgcctgcttgttaacttttattataataagtttttacctacagccacttgatcttttttggcaggggatgcactcaccaaatatgtttttgcatcgctacgcttggtctttttccatagttatcctattactcgcatgtgagactctctctcgactaaaagaagtgactcaaataaaagcaggttttgcttttattttcctcattatactgacatctcttccttatagcttttctcaacaatataattttctacctttaactctttttttacttagtgtttttttattattaggttatactatttcactattttcgtttagaaattctcaaatcccatctacttttatttctgctttcatacttatctttagccttcttgaatcagggttaaacacctactaccagcttcaaggaattaataaggagtggggattcccatcacgacagatatataatagtcaattaaaggatattaacaaccttgtcaactctgtgtcaaaaaatagtcaacctttttttagaatggaaaggctacttccccaaacagggaacgatagcatgaaatttaattattacggcatttcacaattttcctctgtaagaaatagactatctagttctttattggatcgattgggatttcagtctaaaggcacaaatttaaaccttagataccaaaacaatactattattatggacagtctacttggtataaaatataatcttagcgaaggacctccaaataaatttggatttacaaaactaaaaactagcgggaatactactctttatcaaaatcactatagtagccctttagctatattaacacgtaatgtttacaaagatgtcaacctaaatgtcaatacccttgataaccaaaccaaattacttaaccaactaagtgggaaatctttaacctattttaacttacagccagctcaacttatttctggtgctaatcaatttaacggacaaatatctgcacaagcttctgattatcaaaactccgttacccttaattatcaaattaacatccctaaacatagtcaactctatgttagcatacccaatattatattttcaaatcctgatgctaaagagatgcgtattcagacagataatcataatttcatatatactacagataacgcttactctttttttgatttaggatatttcgccgatgccaaagttgctacattttcgtttgtttttccaaaaaataaacaaattagttttaaggaacctcatttttatagtttgtctattgaatcttaccttgaagcaatgaatagcattaaacaaaaaaatgttcatacttacgctaaaagtaatacggtaatcactgattataattcaaaaacgaaaggttctcttatttttacacttccttacgataaaggttggtcagcacaaaaagatgggaaaaatcttccagtcaaaaaagcacaaggaggatttctatcagttactattcctaaaggaaagggacgtgttatccttacctttattcctaatggttttaaattagggttatctctatcttgtgtaggaattatcgcttatatgcttttgtataagtacatagatataaagtctaaattactttag

SEQ ID NO: 96 - DNA, 132 bp, Streptococcus pyogenes
ttttccagatttctgcccacacggagggactattcctcgctatggtcagcctcttgtcgaaatgaacactacaactctcaacaccatcacggagttgggacggtttcgtctaagcagaatccacgaccactt

SEQ ID NO: 97 - DNA, 36 bp, Streptococcus pyogenes
tcgtttatttgggaaaaaagaaaccccgaaggtagc

SEQ ID NO: 98 - DNA, 141 bp, Streptococcus pyogenes
aaggtgaggaaaagacagaagttacaaaagagaagcttttggaattggctagatggattaaagacatctcagacgataccgacgaaaagacagaagatgaggcgtactatgacggagatggaacagaagaaacaaccgttg

SEQ ID NO: 99 - DNA, 96 bp, Streptococcus pyogenes
ctttaccagaagaagcgattaaaaaaatcacagaggctatcaaagttgatgacatcccgtctattaaacaaagctttgatgacctcaaaaatagag

SEQ ID NO: 100 - DNA, 30 bp, Streptococcus pyogenes
tttgttctacaaaaatattccttatggcaa

SEQ ID NO: 101 - DNA, 171 bp, Streptococcus pyogenes
ccaataagtatgcagaaggctatccaggtaatcgctattatggtggaacagaatgtgtggatattgtcgaaacgcttgctattgaacgtgctaagaaacttttcggtgccgcatttgccaatgttcaagcccattccggaagtcaagccaatgcagcagcttatatggcct

SEQ ID NO: 102 - DNA, 105 bp, Streptococcus pyogenes
tttcggaacatcttttgtgactttagttgctgttcctcttttgtatcctgttatcaaaaacttaaaagaaaaggttacaatcggacaagcaaaaagaggtttttg

SEQ ID NO: 103 - DNA, 33 bp, Streptococcus pyogenes
tgggttactgggtgtaaatggtggtttttttgc

SEQ ID NO: 104 - DNA, 144 bp, Streptococcus pyogenes
ctaatgctgaaagccaagaaaaccaattcaaaactcgtaacattgtcccagccaacaaagaagttcaatcttcagaagctgttcaatcaaacgaacttgctaaaaccgttatcactatgggttcttcttcagactacactgtcg

SEQ ID NO: 105 - DNA, 105 bp, Streptococcus pyogenes
ccccgaaatggttggggacgttttgaacgttatgaaagacttggcagaacaaggcatgaccatgttaattgttactcacgaaatgggatttgctcgccaagtagc

SEQ ID NO: 106 - DNA, 105 bp, Streptococcus pyogenes
ttgatgaactgcccatcattgcacttcttgcaacccaagcacaaggaacaacctgtattaaagatgctcaagaattacgagtcaaagaaacagatcgtattcaag

SEQ ID NO: 107 - DNA, 252 bp, Streptococcus pyogenes
aaaacaacgaagtgtaactacctcaaacgtcccaagctggtcgaatccagactacaaagaaccagatttagaagaatttgctctaggaagcatggacggtatagaagatggatcaggagatttttaatttttttaacaaacaaatcaaaaaagattttggtaaaacggcgagtaaagagacttttgctaagtttgctagttactgcgccgaaggaatcgaaaaaaatggagttaagccaatttttaattgga

SEQ ID NO: 108 - DNA, 57 bp, Streptococcus pyogenes
ggcagaagactaccaccaagattacctcaagaaaaatccaaatggctactgccatat

SEQ ID NO: 109 - DNA, 186 bp, Streptococcus pyogenes
ttttggtcgccaggaagcagatattttgttagggacgcaaatgattgccaaaggactggattttccaaatgtgactttagttggggtactaaatgcagatacttccttaaatttgccggattttcgagcgtcagaaaaaacgtttcaattgttaacacaggttgctggtcgggcaggccgtgccca

SEQ ID NO: 110 - DNA, 153 bp, Streptococcus pyogenes
tgcgtgccatcggtgaaatgctctattatgatccagatcaacacacctttatcaattttatttccaaatacattggtccaggctggggttatttttcgggtctatcctattggatttcccttatttttattggaatggcagaaatcacagcag

SEQ ID NO: 111 - DNA, 105 bp, Streptococcus pyogenes
tctgattattttagacatcatgctcccttccttaagtggcttagaagtgctaaaaacaattcgaaagacatcagatgtccctattattatgctaacggcattaga

SEQ ID NO: 112 - DNA, 195 bp, Streptococcus pyogenes
ttactgctgctgaagcagacatcaaagctgaacttgctgctgaaggcaaaccagaaaagatctgggacaaaatcatcccaggtaaaatggaccgcttcatgcttgacaacactaaagttgaccaagcttacactcttcttgcacaagtttacatcatggacgacagcaaaactgttgaagcttaccttgactcag

SEQ ID NO: 113 - DNA, 114 bp, Streptococcus pyogenes
cacctattcgtgaaagacgtttggagtacgctaaagatatgggagaggtgttccgtatgttacaagaaggtagtcaaaaagcaagaactgtggcagccaagactttatcagaag

SEQ ID NO: 114 - DNA, 57 bp, Streptococcus pyogenes
ctgtacgctccacaatctctgtcaaatccttttcttgatagtattccatgtgaccag

SEQ ID NO: 115 - DNA, 183 bp, Streptococcus pyogenes
aacagacgtgacttccttgacaatgtggtaaatcttatcagggtcacggagccacttggcaccagcctcgtttttgacaactttattaacagggcagcccatattaatatcaacaatatcggccttggtattggtttgaatgaaatcagctgcacgtttcaacccttctgcgtcaccaccaaa

SEQ ID NO: 116 - DNA, 54 bp, Streptococcus pyogenes
caagcaccacttgacgatcaccataacaagccaacatattggtcagggtatctt

SEQ ID NO: 117 - DNA, 225 bp, Streptococcus pyogenes
tattttctcaagaaaacacctttgaaggctgcaaaatcttggttgttgtcaccatttggagaaatggctaagacagggtttccttgggcatttttttctaagataaatttgccatctgcatttttaaaggtgccaagtgtgtgtagaccattgtcagaaatcgttttggttgacacattggtctctgaaccaagagtgacaagtcctgtaaagtgtttaccgaca

SEQ ID NO: 118 - DNA, 195 bp, Streptococcus pyogenes
agcaaaaacaaaaggaacaccgataccggttgtaataacggtaaaggcagcaaaagcgtttcccataatcatagtaaaaataaccatgccaagcacataagcgagaacgccaaagaagcggctatcagcaggtacaatctcccgaatgagagaagcaatcacatcaccaacaccagcagctgcaaaaatagctcc

SEQ ID NO: 119 - DNA, 90 bp, Streptococcus pyogenes
ctttttatacatcgatcgcgtttgatattggattttctcgtaatcaatttttccttgtttgtccaaatttacgatgattttttgaatggt

SEQ ID NO: 120 - DNA, 36 bp, Streptococcus pyogenes; identical to SEQ ID NO: 97

SEQ ID NO: 121 - DNA, 150 bp, Streptococcus pyogenes
atcaaacatttgacccaagcaaaacaacggatgccagtatctaaggttctagtagctaaccccttagggtctaaaggaatagctgattcaatccaattgaggatgaaacctttagctgttaagagataccgttcatctctttcaacaagg

SEQ ID NO: 122 - DNA, 150 bp, Streptococcus pyogenes
ccgcctccaccaaatttaccacctgcgtgtaagactgtaaaaactgtttcaacggcgggacgtcctgtcttggcttggatatcaactggaattccacggccatcatctactactgtaatggaattatctgcttcaataaagactttaata

SEQ ID NO: 123 - DNA, 96 bp, Streptococcus pyogenes
gaaaacgagttcaatcagtactatcaagacgcaaaatacaagtcccataaagaacgtcttactatcaatactttcaagagacaaggttatttgagg

SEQ ID NO: 124 - DNA, 111 bp, Streptococcus pyogenes
acaagggtagccccatattttccacaagccttggcaatattttctgagcctgttacattaatagcctcattcaaggcttttccttcgtcttctgctgcatcaactgccgta

SEQ ID NO: 125 - DNA, 243 bp, Streptococcus pyogenes
tcaccttttacaaaatcagttttaacgccttctgcactcaaactttcttcgataaaacgtcctgtaaaaccacccaagaaccctgtcgccgtgctagcaatgtctaaacgttgcaagatgcgactcacattaatgcctttacctccagcaaacttatcatcactcgccatgcgattcactgacccaagatttatttggtcaattctgacaataaagtcaatagaagggtttaaggtcacggta

SEQ ID NO: 126 - DNA, 69 bp, Streptococcus pyogenes
gatcacaatatttattggcattatcaactaaaattgtcacaagttcaaacaatgacttttcctccgctt

SEQ ID NO: 127 - DNA, 63 bp, Streptococcus pyogenes
ccaaatctgctggaccattttctgccaaataacccgcatcaaaaccataaagcaaagctggat

SEQ ID NO: 128 - DNA, 117 bp, Streptococcus pyogenes
caatgtctcataattatcaataatatcaattttcgccataataaaaacactccttcgtgtatcttgaaaagagcgtctctacatgatataatatttcatgcagaaacacttctgtgg

SEQ ID NO: 129 - DNA, 411 bp, Streptococcus pyogenes
gaaaaactcttcagaacggcgcggcaacggtacaacttcaagtgggtttccaaaaagcaaatcatgggtctggtgcttatcgtttttttgaagtcccgcaacaggaatagtgagtccaagttgtttttctatcacatctttggccacattgacttgtccaacgcctccatcaacaataatcaagttaggagcttgcagtccctcctttttcacccgactgtaccttcgaaaaagcacttctctcatactggcataatcatctggtcccaccactgttttaatcttaaatttacgataatctttcttactaggtttgccatcaacaaaaacaaccatagccgcaactggacttgtcccttgaatgttagaattatcaaaggcttcaatgcgcacaggcttgtcaatcctaag

SEQ ID NO: 130 - DNA, 90 bp, Streptococcus pyogenes
gataactgtcgcggatgcctctcgacgaatctcgataacaaaacgcactccttcacggctagattcgtcacgaactgctgtaataccttc

SEQ ID NO: 131 - DNA, 99 bp, Streptococcus pyogenes
ataggttccataaaccaactagtgagcttcgctttagtaacaatggatgaggtaaaaacattatttaaaaccctaataactcctacttttgaggaatgc

SEQ ID NO: 132 - DNA, 117 bp, Streptococcus pyogenes
taccaagtgtgtcagctgcctgagggtgttccccaactgatcgtaaacgcagaccaaacctggttttataaagcaaaaaccaagcaaagaacgaaaaagcaatggcgaagtaaccaa

SEQ ID NO: 133 - DNA, 60 bp, Streptococcus pyogenes
atacttgctaaaatagaaattagccaaaaaacactcataactataataataatgcgctca

SEQ ID NO: 134 - DNA, 138 bp, Streptococcus pyogenes
tttccagatgtcaatgataaggtcattgcgcgtgatagtcggtttttcggtaaagagagaacctgccttttgagcaatcgcttctgggaagtcggtgacaaaaaagttgagaccaaccccaataatgacatcggtgat

SEQ ID NO: 135 - DNA, 135 bp, Streptococcus pyogenes
aaattcaatgttacgcttttgccactctgtcaaaacgagcttgtcatcactttgtttctctttatcttttgccatttacttctccttaatcgcggagctaatatcagctctcaaaaggtcataaaagaagtccgg

SEQ ID NO: 136 - DNA, 171 bp, Streptococcus pyogenes
gagacctctgctttgttagcagctcgcttcatacgctctgcggattctcccaaaataatcatctgcttaagtcctaaaaggtctggcaccaaatcgtcaaattcattgccacgatctagaccgccagcaatcaaaatcaagcgactgttatcaaaacctgataaagctttt

SEQ ID NO: 137 - DNA, 108 bp, Streptococcus pyogenes
aagagactggatgattgcaccctgatattcttctggtgtatcaatttgaacacgctcaaacggttcacatttgacaccatcaatttctttgatgataacttctggacg

SEQ ID NO: 138 - DNA, 135 bp, Streptococcus pyogenes
gaatggctaagtcagcaacactctcatcaatttttacatgataagcgaagctatctggataccgcatttgataaaggtaaatgtacttttcacaaaaagccagttcttcttttaaggtggtcatcttatcttggc

SEQ ID NO: 139 - DNA, 114 bp, Streptococcus pyogenes
catgaccatttgtcacatcaacaatcgttgaagcaacttggaaatcttggtctggatagtaaacataatcaccagaatgataaatattataaagagtctgctgcgcatcgggga

SEQ ID NO: 140 - DNA, 207 bp, Streptococcus pyogenes
gtcatgttaaaagcaccggtcaaattgattttcaagacgcgctcaaaatcctcttccgtcattttaagcatcaatttatcattagtaatgccagcattgttaactaaaacatcaatcgaacctaaactttcgatagcttcattgaccatacgtttagcttctgatgcttctgaaacatccccagagatggtaacaactgtaacgccg

SEQ ID NO: 141 - DNA, 171 bp, Streptococcus pyogenes
agggaattatccagatttagtagctctgcaatcctgctaaaaccactagttaaggtgcctcctaataggacaatggcacctcctaatcctccagctgctccacttcctggtattgtctgtaaatcaatggttgtttggcaaaaaacttttttagcaaagttacttgcaatt

SEQ ID NO: 142 - DNA, 108 bp, Streptococcus pyogenes
gagcactttcaaccaaatcaccaaattgggcaaaaatggaaaaaagagcgaccaaaaccaacatggtcaaaaagtgatgtggcgcataaacagacctatcaatcacca

SEQ ID NO: 143 - DNA, 192 bp, Streptococcus pyogenes
aaatcaaggtctttaaggacttcttcgatcacctcgtccacggttttttcctctccaactattttagtattaagcccatcacttgttaacatctgctcaggcgctttttgttgggattcgggattggcacaccatggacatctcaaggggcaaccttttaaaaaaacggttgtccgaataccaggaccgtca

SEQ ID NO: 144 - DNA, 48 bp, Streptococcus pyogenes
cgaaatgaaatcaacacttcctctcctacgctttcttctaccaaaata

SEQ ID NO: 145 - DNA, 69 bp, Streptococcus pyogenes
tgctccttagcagcttttaccaaattttcaaaatcagccattgttccaaaatcagggttgaccgccgta

SEQ ID NO: 146 - DNA, 138 bp, Streptococcus pyogenes
gaggccatgtcttgccagcgttgctgttcttttttagctgactcttctttgatacgatatgatttggccaagtcctccgtggtcatagctgccatgatttttaaaatggcttggctgtcttgtggaaggaggtgtggg

SEQ ID NO: 147 - DNA, 132 bp, Streptococcus pyogenes
aatttcaaagctcgaccacctggtgttgtttcaggatttccaaacatcacaccaactttttcacgcaattggttaataaagatagcgatagtttttgttttattaatagaagctgataatttacgcatggcc

SEQ ID NO: 148 - DNA, 114 bp, Streptococcus pyogenes
aaagagacctgccactacagccaccaacatcatgtcattttccaagccaagttcgataggaactttttgccacatccagataaaagcggacatcagaactgttccatagatggt

SEQ ID NO: 149 - DNA, 234 bp, Streptococcus pyogenes
attaccctgttgaccaagcaaacgcagcaactgttcaggaagcccagtctttcaaacaatctgttgaagcatctcttggtaaagagaatgtcattgtcaatgttcttgaaacagaaacatcaactcacgaagcccaaggcttctatgctgagaccccagaacaacaagactacgatatcatttcatcatggtggggaccagactatcaagatccacggacctaccttgacatca

SEQ ID NO: 150 - DNA, 60 bp, Streptococcus pyogenes
tcgggaagacaggattcgaacctgcgacaccttggtcccaaaccaagtactctaccaagc

SEQ ID NO: 151 - protein, 428 aa, Streptococcus pyogenes
MRKLLAAMLMTFFLTPLPVISTEKKLIFSKNAVYQLKQDVVQSTQFYNQIPSNPNLYQETCAYKDSDLTLPAGRLGVNQPLLIKSLVLNKESLPVFELADGTYVEANRQLIYDDIVLNQVDIDSYFWTQKKLRLYSAPYVLGTQTIPSSFLFAQKVHATQMAQTNHGTYYLIDDKGWASQEDLVQFDNRMLKVQEMLLQKYNNPNYSIFVKQLNTQTSAGINADKKMYAASISKLAPLYIVQKQLQKKKLAENKTLTYTKDVNHFYGDYDPLGSGKISKIADNKDYRVEDLLKAVAQQSDNVATNILGYYLCHQYDKAFRSEIKALSGIDWDMEQRLLTSRSAANMMEAIYHQKGQIISYLSNTEFDQQRITKNITVPVAHKIGDAYDYKHDVAIVYGNTPFILSIFTNKSTYEDITAIADDVYGILK

SEQ ID NO: 152 - protein, 398 aa, Streptococcus pyogenes
MKKRILSAVLVSGVTLGAATTVGAEDLSTKIAKQDSIISNLTTEQKAAQNQVSALQAQVSSLQSEQDKLTARNTELEALSKRFEQEIKALTSQIVARNEKLKNQARSAYKNNETSGYINALLNSKSISDVVNRLVAINRAVSANAKLLEQQKADKVSLEEKQAANQTAINTIAANMAMAEENQNTLRTQQANLVAATANLALQLASATEDKANLVAQKEAAEKAAAEALAQEQAAKVKAQEQAAQQAASVEAAKSAITPAPQATPAAQSSNAIEPAALTAPAAPSAGPQTSYDSSNTYPVGQCTWGAKSLAPWAGNNWGNGGQWAYSAQAAGYRTGSTPMVGAIAVWNDGGYGHVAVVVEVQSASSIRVMESNYSGRQYIADHRGWFNPTGVTFIYPH

SEQ ID NO: 153 - protein, 1257 aa, Streptococcus pyogenes
MSSYFPVAPLSDLVSYMNKRIFVEKKADFGIKSASLVKELTHNLQLTSLKALRIVQVYDVFNLAEDLLARAEKHIFSEQVTDCLLTETEITAELDKVAFFAIEALPGQFDQRAASSQEALLLFGSDSQVKVNTAQLYLVNKDITEAELEAVKNYLLNPVDSRFKDITLPLEEQAFSVSDKTIPNLDFFETYQADDFATYKAEQGLAMEVDDLLFIQNYFKSIGCVPTETELKVLDTYWSDHCRHTTFETELKNIDFSASKFQKQLQTTYDKYIAMRDELGRSEKPQTLMDMATIFGRYERANGRLDDMEVSDEINACSVEIEVDVDGVKEPWLLMFKNETHNHPTEIEPFGGAATCIGGAIRDPLSGRSYVYQAMRISGAGDITTPIAETRAGKLPQQVISKTAAHGYSSYGNQIGLATTYVREYFHPGFVAKRMELGAVVGAAPKENVVREKPEAGDVVILLGGKTGRDGVGGATGSSKVQTVESVETAGAEVQKGNAIEERKIQRLFRDGNVTRLIKKSNDFGAGGVCVAIGELADGLEIDLDKVPLKYQGLNGTEIAISESQERMSVVVRPNDVDAFIAACNKENIDAVVVATVTEKPNLVMTWNGEIIVDLERRFLDTNGVRVVVDAKVVDKDLTVPEARTTSAETLEADTLKVLSDLNHASQKGLQTIFDSSVGRSTVNHPIGGRYQITPTESSVQKLPVQHGVTTTASVMAQGYNPYIAEWSPYHGAAYAVIEATARLVATGADWSRARFSYQEYFERMDKQAERFGQPVSALLGSIEAQIQLGLPSIGGKDSMSGTFEDLTVPPTLVAFGVTTADSRKVLSPEFKAAGENIYYIPGQAISEDIDFDLIKDNFSQFEAIQAQHKITAASAAKYGGVLESLALMTFGNRIGASVEIAELDSSLTAQLGGFVFTSAEEIADAVKIGQTQADFTVTVNGNDLAGASLLAAFEGKLEEVYPTEFEQTDVLEEVPAVVSDTVIKAKETIEKPVVYIPVFPGTNSEYDSAKAFEQVGASVNLVPFVTLNEVAIAESVDTMVANIAKANIIFFAGGFSAADEPDGSAKFIVNILLNEKVRAAIDSFIEKGGLIIGICNGFQALVKSGLLPYGNFEEAGETSPTLFYNDANQHVAKMVETRIANTNSPWLAGVEVGDIHAIPVSHGEGKLVVSASEFAELRDNGQIWSQYVDFDGQPSMDSKYNPNGSVNAIEGITSKNGQIIGKMGHSERWEDGLFQNIPGNKDQILFASAVKYFTGK

SEQ ID NO: 154 - protein, 374 aa, Streptococcus pyogenes
MKKFHRFLVSGVILLGFNGLVPTMPSTLISQQENLVHAAVLGDNYPSKWKKGNGIDSWNMYIRQCTSFAAFRLSSANGFQLPKGYGNACTWGHIAKNQGYPVNKTPSIGAIAWFDKNAYQSNAAYGHVAWVADIRGDTVTIEEYNYNAGQGPERYHKRQIPKSQVSGYIHFKDLSSQTSHSYPRQLKHISQASFDPSGTYHFTTRLPVKGQTSIDSPDLAYYEAGQSVYYDKVVTAGGYTWLSYLSFSGNRRYIPIKEPAQSVVQNDNTKPSIKVGDTVTFPGVFRVDQLVNNLIVNKELAGGDPTPLNWIDPTPLDETDNQGKVLGDQILRVGEYFIVTGSYKVLKIDQPSNGIYVQIGSRGTWVNADKANKL

SEQ ID NO: 155 - protein, 108 aa, Streptococcus pyogenes
MINQWNNLRHKKLKGFTLLEMLLVILVISVLMLLFVPNLSKQKDRVTETGNAAVVKLVENQAELYELSQGSKPSLSQLKADGSITEKQEKAYQDYYDKHKNEKARLSN

SEQ ID NO: 156 - protein, 256 aa, Streptococcus pyogenes
MKIGIIGVGKMASAIIKGLKQTPHELIISGSSLERSKEIAEQLALPYAMSHQDLIDQVDLVILGIKPQLFETVLKPLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGIPKAKALEIVTQTVLASASNLKTSSQSPHDFIDAICSPGGTTIAGLMELERLGLTATVSSAIDKTIDKAKSL

SEQ ID NO: 157 - protein, 355 aa, Streptococcus pyogenes
MTDLFSKIKEVTELDGIAGYEHSVRDYLRTKITPLVDRVETDGLGGIFGIRDSKAEKAPRILVAAHMDEVGFMVSDIKVDGTLRVVGIGGWNPLVVSSQRFTLYTRTGQVIPLISGSVPPHFLRGANGSASLPHIEDIVFDGGFTDKAEAERFGITPGDIIIPQSETILTANQKNIISKAWDNRYGVLMITEMLEALKGQDLNNTLIAGANVQEEVGLRGAHVSTTKFDPELFFAVDCSPAGDIYGNPGTIGDGTLLRFYDPGHVMLKDMRDFLLTTAEEAGVNFQYYCGKGGTDAGAAHLQNGGVPSTTIGVCARYIHSHQTLYAMDDFVEAQAFLQAIIKKLDRSTVDLIKCY

SEQ ID NO: 158 - protein, 118 aa, Streptococcus pyogenes
MEDISDPEVILEYGVYPAFIKGYTQLKANIEEALLEMSNSGQALDIYQAVQTLNAENMLLNYYESLPFYLNRQSILANMTKALKDAHIREAMAHYKLGEFAHYQDTMLDMVERTIKTF

SEQ ID NO: 159 - protein, 571 aa, Streptococcus pyogenes
MSNKKTFKKYSRVAGLLTAALIIGNLVTANAESNKQNTASTETTTTNEQPKPESSELTTEKAGQKTDDMLNSNDMIKLAPKEMPLESAEKEEKKSEDKKKSEEDHTEEINDKIYSLNYNELEVLAKNGETIENFVPKEGVKKADKFIVIERKKKNINTTPVDISIIDSVTDRTYPAALQLANKGFTENKPDAVVTKRNPQKIHIDLPGMGDKATVEVNDPTYANVSTAIDNLVNQWHDNYSGGNTLPARTQYTESMVYSKSQIEAALNVNSKILDGTLGIDFKSISKGEKKVMIAAYKQIFYTVSANLPNNPADVFDKSVTFKELQRKGVSNEAPPLFVSNVAYGRTVFVKLETSSKSNDVEAAFSAALKGTDVKTNGKYSDILENSSFTAVVLGGDAAEHNKVVTKDFDVIRNVIKDNATFSRKNPAYPISYTSVFLKNNKIAGVNNRTEYVETTSTEYTSGKINLSHQGAYVAQYEILWDEINYDDKGKEVITKRRWDNNWYSKTSPFSTVIPLGANSRNIRIMARECTGLAWEWWRKVIDERDVKLSKEINVNISGSTLSPYGSITYK

SEQ ID NO: 160 - protein, 142 aa, Streptococcus pyogenes
MKQQSYQPLRFVYLLVALFAALLLIARPVMADEGTNSADAAYYKGQSAGKKAGKKAGKEATWTDLTPTVPTNPETPSDIGETTNKQLYKEGYKDGYKEGYNEGWKSQYPVLTPVKVIWDLISYWLQRLFPNNQSSTAAQSMS

SEQ ID NO: 161 - protein, 108 aa, Streptococcus pyogenes
VKNKLFLVALATVTVLGPSLATPHHQTVHASDVTLTETCDKNGTVCFGYENVDGEVCKLTADGKGTICVGYENRDIKESETSSTKNDCSNWFWCFLNYLWTTIKSWVS

SEQ ID NO: 162 - protein, 398 aa, Streptococcus pyogenes
METILEVKHLSKIFGKKQKAALEMVKTGKNKSEIFKKTGATVGVYDASFEVKKGEIFVIMGLSGSGKSTLVRMLNRLIEPSAGSILLEGKDISTMSADQLREVRRHDINMVFQSFALFPHKTILENTEFGLELRGVPKEERQRLAEKALDNSGLLDFKDQYPNQLSGGMQQRVGLARALANSPKILLMDEAFSALDPLIRREMQDELLDLQDSMKQTIIFISHDLNEALRIGDRIALMKDGQIMQIGTGEEILTNPANDFVREFVEDVDRSKVLTAQNIMIKPLTTTVELDGPQVALNRMHNEEVSMLMATNRRRQLVGSLTADAAIEARKKGLPLSEVIDRDVRTVSKDTIITDILPLIYDSSAPIAVTDDNNRLLGVIIRGRVIEALANISDEDLN

SEQ ID NO: 163 - protein, 594 aa, Streptococcus pyogenes
MKTARFFWFYFKRYRFSFTVIAVAVILATYLQVKAPVFLGESLTELGKIGQAYYVAKMSGQTHFSPDLSAFNAVMFKLLMTYFFTVLANLIYSFLLTRVVSHSTNRMRKGLFGKLERLTVAFFDRHKDGEILSRFTSDLDNIQNSLNQSLIQVVTNIALYIGLVWMMFRQDSRLALLTIASTPVALIFLVINIRLARKYTNIQQQEVSALNAFMDETISGQKAIIVQGVQEDTMTAFLKHNERVRQATFKRRLFSGQLFPVMNGMSLINTAIVIFVGSTIVLSDKSMPAAAALGLVVTFVQYSQQYYQPMMQIASSWGELQLAFTGAHRIQEMFDETEEVRPQNAPAFTSLKEAVAINHVDFGYLPGQKVLSDVSIVAPKGKMIAVVGPTGSGKTTIMNLINRFYDVDAGSITFDGRDIRDYDLDSLRQKVGIVLQESVLFSGTITDNIRFGDQTISQDMVETAARATHIHDFIMSLPKGYNTYVSDDDNVFSTGQKQLISIARTLLTDPEVLILDEATSNVDTVTESKIQRAMEAIVAGRTSFVIAHRLKTILNADHIIVLKDGKVIEQGNHHELLHQKGFYAELYHNQFVFE

SEQ ID NO: 164 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 165 - protein, 420 aa, Streptococcus pyogenes
MTKEKLVAFSQAHAEPAWLQERRLAALEAIPNLELPTIERVKFHRWNLGDGTLTENESLASVPDFIAIGDNPKLVQVGTQTVLEQLPMALIDKGVVFSDFYTALEEIPEVIEAHFGQALAFDEDKLAAYHTAYFNSAAVLYVPDHLEITTPIEAIFLQDSDSDVPFNKHVLVIAGKESKFTYLERFESIGNATQKISANISVEVIAQAGSQIKFSAIDRLGPSVTTYISRRGRLEKDANIDWALAVMNEGNVIADFDSDLIGQGSQADLKVVAASSGRQVQGIDTRVTNYGQRTVGHILQHGVILERGTLTFNGIGHILKDAKGADAQQESRVLMLSDQARADANPILLIDENEVTAGHAASIGQVDPEDMYYLMSRGLDQETAERLVIRGFLGAVIAEIPIPSVRQEIIKVLDEKLLNR

SEQ ID NO: 166 - protein, 410 aa, Streptococcus pyogenes
MIKRLISLVVIALFFAASTVSGEEYSVTAKHAIAVDLESGKVLYEKDAKEVVPVASVSKLLTTYLVYKEVSKGKLNWDSPVTISNYPYELTTNYTISNVPLDKRKYTVKELLSALVVNNANSPAIALAEKIGGTEPKFVDKMKKQLRQWGISDAKVVNSTGLTNHFLGANTYPNTEPDDENCFCATDLAIIARHLLLEFPEVLKLSSKSSTIFAGQTIYSYNYMLKGMPCYREGVDGLFVGYSKKAGASFVATSVENQMRVITVVLNADQSHEDDLAIFKTTNQLLQYLLINFQKVQLIENNKPVKTLYVLDSPEKTVKLVAQNSLFFIKPIHTKTKNTVHITKKSSTMIAPLSKGQVLGRATLQDKHLIGQGYLDTPPSINLILQKNISKSFFLKVWWNRFVRYVNTSL

SEQ ID NO: 167 - protein, 308 aa, Streptococcus pyogenes
MESIDKSKFRFVERDSEASEVIDTPAYSYWKSVFRQFFSKKSTVFMLVILVTVLMMSFIYPMFANYDFNDVSNINDFSKRYIWPNAEYWFGTDKNGQSLFDGVWYGARNSILISVIATLINITIGVVLGAIWGVSKAFDKVMIEIYNIISNIPSMLIIIVLTYSLGAGFWNLILAFCITGWIGVAYSIRVQILRYRDLEYNLASQTLGTPMYKIAVKNLLPQLVSVIMTMLSQMLPVYVSSEAFLSFFGIGLPTTTPSLGRFIANYSSNLTTNAYLFWIPLVTLILVSLPLYIVGQNLADASDPRSHR

SEQ ID NO: 168 - protein, 524 aa, Streptococcus pyogenes
LALTDFKDKDQQDQQRSFKEQILAELEKANQIRKEKEEELFQKELEAKEAARRTAQLYAEYKRQDAFQKESIAHNNKTAKHFQAIKGAVMTSEALKPTLLSEKENSSLKTTNKRVVQANELQETASKESQVPLTIEKGHSVRRKLSKRQQTERAAKKISTVLISSIIITLLAVTLAGAGYVYSALNPVDKNSDAFVQVEIPSGSGNKLIGQILQKKGLIKNSTVFSFYTKFKNFTNFQSGYYNLQKSMSLEEIASALQEGGTAEPTKPSLGKILIPEGYTIKQIAKAVEHNSKGKTKKAKTPFNEKDFLDLVTDEAFIQDMVKRYPKLLATIPTKEKAIYRLEGYLFPATYNYYKETTMRELVEDMLAAMDATLVPYYDKIAASGKTVNEVLTLASLVEKEGSTDDDRRQIASVFYNRLNSGMALQSNIAILYAMGKLGEKTTLAEDATIDTTINSPYNIYTNTGLMPGPVASSGVSAIEATLNPASTDYLYFVANVHTGEVYYAKTFEEHSANVEKYVNSQIQ

SEQ ID NO: 169 - protein, 1647 aa, Streptococcus pyogenes
VEKKQRFSLRKYKSGTFSVLIGSVFLVMTTTVAADELSTMSEPTITNHAQQQAQHLTNTELSSAESKSQDTSQITLKTNREKEQSQDLVSEPTTTELADTDAASMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASVSAIESTAWYGITARGSKVMPGDYQYVVTYRDEHGKEHQKQYTISVNDKKPMITQGRFDTINGVDHFTPDKTKALDSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKITMLATSQITAHFDHLLPEGSRVSLKTAQDQLIPLEQSLYVPKAYGKTVQEGTYEVVVSLPKGYRIEGNTKVNTLPNEVHELSLRLVKVGDASDSTGDHKVMSKNNSQALTASATPTKSTTSATAKALPSTGEKMGLKLRIVGLVLLGLTCVFSRKKSTKD

SEQ ID NO: 170 - protein, 184 aa, Streptococcus pyogenes
MKWSGFMKTKSKRFLNLATLCLALLGTTLLMAHPVQAEVISKRDYMTRFGLGDLEDDSANYPSNLEARYKGYLEGYEKGLKGDDIPERPKIQVPEDVQPSDHGDYRDGYEEGFGEGQHKRDPLETEAEDDSQGGRQEGRQGHQEGADSSDLNVEESDGLSVIDEVVGVIYQAFSTIWTYLSGLF

SEQ ID NO: 171 - protein, 210 aa, Streptococcus pyogenes
MKKTLTLLLALFAIGVTSSVRAEDEQSSTQKPVKFDLDGPQQKIKDYSGNTITLEDLYVGSKVVKIYIPQGWWVYLYRQCDHNSKERGILASPILEKNITKTDPYRQYYTGVPYILNLGEDPLKKGEKLTFSFKGEDGFYVGSYIYRDSDTIKKEKEAEEALQKKEEEKQQKQLEESMLKQIREEDHKPWHQRLSESIQDQWWNFKGLFQ

SEQ ID NO: 172 - protein, 204 aa, Streptococcus pyogenes
MKKTLTLLLALFAIGVTSSVRAEDEQNKFILDGLQEKVKEVSVSDFSVGESKIKVWLPQAWSVKISREHSPKSSISNSGEQKPLSNSSENKEGQFSKRLPYGTQHTIKLSSQLTKGERVTLTFRDEDFWGAGYCFYRDSLSIKEDKQYEEEIKKIEDDLERQDLENDALEMFKKQTEREANKPWHQRLSENIQDQWWNFKGLFQ

SEQ ID NO: 173 - protein, 389 aa, Streptococcus pyogenes
MIITKKSLFVTSVALSLVPLATAQAQEWTPRSVTEIKSELVLVDNVFTYTVKYGDTLSTIAEAMGIDVHVLGDINHIANIDLIFPDTILTANYNQHGQATNLTVQAPASSPASVSHVPSSEPLPQASATSQPTVPMAPPATPSDVPTTPFASAKPDSSVTASSELTSSTNDVSTELSSESQKQPEVPQEAVPTPKAAETTEVEPKTDISEAPTSANRPVPNESASEEVSSAAPAQAPAEKEETSAPAAQKAVADTTSVATSNGLSYAPNHAYNPMNAGLQPQTAAFKEEVASAFGITSFSGYRPGDPGDHGKGLAIDFMVPENSALGDQVAQYAIDHMAERGISYVIWKQRFYAPFASIYGPAYTWNPMPDRGSITENHYDHVHVSFNA

SEQ ID NO: 174 - protein, 331 aa, Streptococcus pyogenes
LRQIQSIRLIDVLELAFGVGYKEETTSQFSSDQPSQVVLYRGEANTVRFAYTNQMSLMKDIRIALDGSDKSLTAQIVPGMGHVYEGFQTSARGIFTMSGVPESTVPVANPNVQTKYIRYFKVIDDMHNTMYKGTVFLVQPQAWKYTMKSVDQLPVDDLNHIGVAGIERMTTLIKNAGALLTTGGSGAFPDNIKVSINPKGRQATITYGDGSTDIIPPAVLWKKGSVKEPTEADQSVGTPTPGIPGKFKRDQSLNEHEAMVNVEPLSHVVKDNIKVIDEKSTGRFEPFRPNEDEKEKPASDVKVRPAEVGSWLEPATALPSVEMSAEDRLKS

SEQ ID NO: 175 - protein, 332 aa, Streptococcus pyogenes
MKVLLYLEAENYLRKSGIGRAIKHQAKALSLVGQHFTTNPRETYDLVHLNTYGLKSWLLMIKAQKAGKKVIMHGHSTEEDFRNSFIFSNLLSPWFKKYLCHFYNKADAIITPTLYSKSLIESYGVKSPIFAVSNGIDLEQYGADPKKEAAFRRYFDIKEGEKVVMGAGLFFLRKGIDDFVKVAQAMPDVRFIWFGETNKWVIPAQVRQMVNGNHPKNLIFPGYIKGDVYEGAMTGADAFFFPSREETEGIVVLEALASRQHLVLRDIPVYYGWVDQSSAELATDIPGFIEALKKVFSGASNKVEAGYKVAQSRRLETVGHALVDVYKKVMEL

SEQ ID NO: 176 - protein, 710 aa, Streptococcus pyogenes
MENNNNHNIAEALSVSLHQIEQVLALTAQGNTIPFIARYRKEVTGNLDEVVIKSIIDMDKSLTTLNERKATILAKIEEQGKLTDQLRTSIEATEKLADLEELYLPYKEKRRTKATIAREAGLFPLARLILQNAQNLETAAEPFVTEGFASPQEALAGAVDILVEAMSEDAKLRSWTYNEIWQYSRLVSTLKDEQLDEKKVFQIYYDFSDQVSNMQGYRTLALNRGEKLGILKVSFEHNLEKMQRFFSVRFKETNPYIEEVINQTIKKKIVPAMERRVRSELSDAAEDGAIHLFSENLRHLLLVSPLKGKMVLGFDPAFRTGAKLAIVDQTGKLLTTQVIYPVAPASQTKIQAAKETLTQLIETYQIDIIAIGNGTASRESEAFVADVLKDFPNTSYVIVNESGASVYSASELARHEFPDLTVEKRSAISIARRLQDPLAELVKIDPKSIGVGQYQHDVSQKKLSENLGFVVDTVVNQVGVNVNTASPSLLAHVSGLNKTISENIVKYREENGALTSRADIKKVPRLGAKAFEQAAGFLRIPGAKNILDNTGVHPESYPAVKELFKVLGIQDLDDAAKATLAAVQVPQMAETLAIGQETLKDIIADLLKPGRDLRDDFEAPILRQDILDLKDLEIGQKLEGTVRNVVDFGAFVDIGVHEDGLIHISEMSKTFVNHPSQVVSVGDLVTVWVSKIDLDRHKVNLSLLPPRDTH

SEQ ID NO: 177 - protein, 433 aa, Streptococcus pyogenes
MNEKVFRDPVHNYIHIDNPLIYDLINTKEFQRLRRIKQVPTTAFTFHGAEHSRFSHCLGVYEIARRVTAIFEEKYADIWNKDESLVTMTAALLHDIGHGAYSHTFEVLFHTDHEAFTQEIITNPETEINAILVRHAPDFPDKVASVINHTYPNKQVVQLISSQIDCDRMDYLLRDSYFSAANYGQFDLMRILRVIRPVEDGIVFEHSGMHAVEDYIVSRFQMYMQVYFHPASRAVELILQNLLKRAQHLYPEQQAYFQKTAPGLIPFFEKKANLADYIALDDGVMNTYFQVWMASEDHILSDLASRFINRKILKSVTFDQDSQGELERLRQLVESVGFDPDYYTGIHINFDLPYDIYRPELENPRTQIEMMQKDGSLAELSQLSPIVKALTGTTYGDRRFYFPKEMLELDDLFAPSKETFMSYISNGHFHFSQ

SEQ ID NO: 178 - protein, 260 aa, Streptococcus pyogenes
MDINLLQALLIGLWTAFCFSGMLLGIYTNRCIILSFGVGIILGDLPTALSMGAISELAYMGFGVGAGGTVPPNPIGPGIFGTLMAITSAGKVTPEAALALSTPIAVAIQFLQTFAYTAFAGAPETAKKQLQKGNIRGFKFAANGTIWAFAFIGLGLGLLGALSMDTLLHLVDYIPPVLLNGLTVAGKMLPAIGFAMILSVMAKKELIPFVLIGYVCAAYLQIPTIGIAIIGIIFALNEFYNKPKQVDATTVQGGQQDDWI

SEQ ID NO: 179 - protein, 403 aa, Streptococcus pyogenes
LTPRSGKTTAGHFRYARYLIESEDENHLVTAYNQEQAYRLFIDGDGTGLMHIFDGNCEIKHDERGDHLLITTPKGNKRVYYKGGGKVNSVGAITGMSLGSVVFCEINLLHMDFIQECFRRTWAAKLRYHLADLNPPAPQHPVIKDVFDVQNTRWTHWTMDDNPILTAERKQNIINSLKKNPYLYKRDVLGQRVMPQGVIYGLFDTEKNVLDALIGEPVEMYFCADGGQSDATSMSCNIVTRVRDNGRISFRLNRVAHYYHSGADTGQVKAMSTYALELKVFIDWCVKKYQMRYTEVFVDPACKSLREELHKLGVFTLGAPNNSKDVSSKAKGIEVGIERGQNIISDGAFYLVNHSEEEYDHYHFLKEIGLYSRDDNGKPIDKDNHAMDEFRYSVNVFVHRYYN

SEQ ID NO: 180 - protein, 497 aa, Streptococcus pyogenes
MKKKPIKLNDEQLLLEASQLSDMYHQLTLDLFDQVIERIKARGSASLADNPYLWQANKLHDVGLLNADNIKLIAKYSGIAEAQLRYIIKNEGFKIYKNTSEQLEEALGRESGVNSTIQDDLSNYARQAIDDVHNLTNTTLPFSVIGAYQGIIQDAVAGVVTGLKTPDQAINQTVIKWFKKGFYGFTDKAGRKWRADSYARTVINTTTWRVFNEAKEAPAREFGIDTFYYSKKATAREMCAPLQHQIVTTGEAREEGGIKILALSDYGHGEPDGCLGINCKHTKTPFVVGVNSKPELPEHLKNITPAQAKANANAQAKQRAIERSIRKSKELLHVAKQLGDKELIRQYQSDVRSKQDALNYLINNNAFLHRNQAREKRYNNPYTKTQSEVEVRKEKAKLDKRRDVESAIIGVETSEGIPLKITKHLAERAVLRNIAPIDIVDSIKEPLKIAPIKYDNLDRPSQKYIGKCVSTVINPIDGNIVTVHATSTRIRKKYGGN

SEQ ID NO: 181 - protein, 628 aa, Streptococcus pyogenes
MSRDPTLILDESNLVIGKDGRVHYTFTTEDDNPKVRLASKCLGTAHFNQLMIERGDQATSYVAPVVVEGTGNPTGLFKDLKEISLELTDTANSQLWSKIKLTNRGMLQEYYDGKIKTEIVNSARGVATRISEDTDKKLALINDTIDGIRREYRDADRKLSASYQAGIEGLKATMANDKIGLQAEIKASAQGLSQKYDDELRKLSAKITTTSSGTTEAYESKLAGLRAEFTRSNQGTRTELESQISGLRAVQQSTASQISQEIRDREGAVSRVQQSLESYQRRMQDAEENYSSLTHTVRGLQSDVGSPTGKIQSRLTQLAGQIEQRVTRDGVMSIISGAGDSIKLAIQKAGGINAKMSGNEIISAINLNSYGVTIAGKHIALDGNTTVNGTFTTKIAEAIKIRADQIIAGTIDAARIRVINLNASSIVGLDANFIKAKIGYAITDLLEGKVIKARNGAMLIDLNTAKMDFNSDATINFNSKNNALVRKDGTHTAFVHFSNATPKGYTGSALYASIGITSSGDGVNSASSGRFAGLRSFRYATGYNHTAAVDQTEIYGDNVLVVDDFNITRGFKFRPDKMQKMLDMNDLYAAVVALGRCWGHLANVGWNTAHSNFTSAVNRELNNYITKI

SEQ ID NO: 182 - protein, 400 aa, Streptococcus pyogenes
MTFLDKIKQGCLDGWAKYKILPSLTAAQAILESGWGKHAPHNALFGIKADSSWTGKSFDTKTQEEYQAGVVTDIVDRFRAYDSWDESIADHGQFLVDNPRYEAVIGETDYKKACYAIKAAGYATASSYVELLIQLIEENDLQSWDREALKNNKEETMTTANEIVQYCVNLANSGMGVDKDGAHGTQCCDLPCFVAKNWFGVDLWGNAIDLLDSASAQGWEVHRMPTEANPKAGATFVQSVPYHQFGHTGIVIEDSDGYTMRTVEQNIDGNPDALYVGAPARFNTRDFTGVIGWFYPPYQGDTVTQPVSTEPQTSDTIVETAKTGTFTLDVAEINIRRWPSLASEVVGIYKQGDTVSFDSEGYANGYYWISYVGGSGMRNYLGIGQTDKDGNRISLWGKLN

SEQ ID NO: 183 - protein, 235 aa, Streptococcus pyogenes
MKKINIIKIVFIITVILISTISPIIKSDSKKDISNVKSDLLYAYTITPYDYKNCRVNFSTTHTLNIDTQKYRGKDYYISSEMSYEASQKFKRDDHVDVFGLFYILNSHTGEYIYGGITPAQNNKVNHKLLGNLFISGESQQNLNNKIILEKDIVTFQEIDFKIRKYLMDNYKIYDATSPYVSGRIEIGTKDGKHEQIDLFDSPNEGTRSDIFAKYKDNRIINMKNFSHFDIYLEK

SEQ ID NO: 184 - protein, 313 aa, Streptococcus pyogenes
MITTFETILDKIKAHQTIIIHRHQNPDPDALGSQAGLKEIIAQNFPDKKVLMTGFDEPSLAWISQMDQVTDKDYKEALVIITDTANRPRIDDERYTLGKCLIKIDHHPNDDVYGDFYYVDTSASSASEIIADFAFSQNLTLSDKAAKLLYTGIVGDTGRFLYASTTSKTLSIASQLRHFEFDFAAISRQMDSFPLKIAKLQSYVFEHLTIDESGAAYVLVSQETLKHFDVTLAESSAIVCAPGKIDNVQAWAIFVELTDGNYRVRMRSKEKIINGIAKRHGGGGHPLASGANSANLEENQAIFRELIAVCQEI

SEQ ID NO: 185 - protein, 650 aa, Streptococcus pyogenes
MIEENKHFEKKMQEYDASQIQVLEGLEAVRMRPGMYIGSTAKEGLHHLVWEIVDNSIDEALAGFASHIKVFIEADNSITVVDDGRGIPVDIQAKTGRPAVETVFTVLHAGGKFGGGGYKVSGGLHGVGSSVVNALSTQLDVRVYKNGQIHYQEFKRGAVVADLEVIGTTDVTGTTVHFTPDPEIFTETTQFDYSVLAKRIQELAFLNRGLKISITDKRSGMEQEEHFLYEGGIGSYVEFLNDKKDVIFETPIYTDGELEGIAVEVAMQYTTSYQETVMSFANNIHTHEGGTHEQGFRAALTRVINDYAKKNKILKENEDNLTGEDVREGLTAVISVKHPNPQFEGQTKTKLGNSEVVKITNRLFSEAFQRFLLENPQVARKIVEKGILASKARIAAKRAREVTRKKSGLEISNLPGKLADCSSNDANQNELFIVEGDSAGGSAKSGRNREFQAILPIRGKILNVEKATMDKILANEEIRSLFTAMGTGFGADFDVSKARYQKLVIMTDADVDGAHIRTLLLTLIYRFMRPVLEAGYVYIAQPPIYGVKVGSEIKEYIQPGIDQEDQLKTALEKYSIGRSKPTVQRYKGLGEMDDHQLWETTMDPENRLMARVTVDDAAEADKVFDMLMGDRVEPRRDFIEENAVYSTLDI

SEQ ID NO: 186 - protein, 2045 aa, Streptococcus pyogenes
MRKVKKVFVSSCMLLTVGLGVAVPTGFSQSNGVMVVKAAEVPATDLSRQASDSERVDESSLLQKENLSVDSFKLENLNGWEAENDTAGNLGKFKDPDSSGYQNILTSSGKNISVAVAPKGSGKMNIKVTKRSNFQGGYYVGGLRTQTPVLKLNDVYRYSFTTKKLSGNSSEFKTRVKPVESNNKLGKELVIRVDNKNVSTKHDWLPDISDGTHTVDFTGLDKKLSVAFRFSPRQTSNVVYEFSNINIKNISPASVPAIPSKVLEGTSVLSGTAISSGDTLEKRKSFDGDILRVYKDSKIIARTVIKGNKWDVKLSKPLIAGEKLDFEILHPRSQNVSKKISKQVEAKPFDPASYKEKVIAKLKPVYEATSEKITNDAWLDENAKDLQKQKLEEQYISGKVAISEAGTKQEAIDAAYNKYSSQTDPDSLPSQYKQGNKENEQEKGRQDLIQTRDLTLKAIQEDKWLTEQEKTIQKEEALKAFETGIESVNQTVSLEQLKQRLIVYKASEKDSEKKEYPESIPNQHIPGKEKEVKAAKQEELKKLHDTTLEKINQDKWLTPDQQAEQLKQAEVTFKKGQEAIKSAQTLTQLETDLADYVSENEGKGNSIPDKYKSGNKDDLVNKAEVKLKEAHEATKQAIEKDPWLSPEQKKAQKEKAKARLDEGLKALKAADSLEILKVTEEAFVDKEKNPDSIPNQHKAGTADQARKQALDSLDKEVQKELESIDNDNTLTTDEKAAAKKKVNDAYDVAKQTAMEANSYEDLTTIKDEFLSNLPHKQGTPLKDQQSDAIAELEKKQQEIEKAIEGDKTLPRDEKEKQIADSKERLKSDTQKVKDAKNADAIKKAFEEGKVNIPQAHIPGDLNKDKEKLLAELKQKADDTEKAIDVDKTLTEDEKKEQKVKTKAELEKAKTDVKNTQTREELDKKVPELKKAIEDTHVKGNLEGVKNKAIEDLKKAHTETVAKINGDDTLDKATKEAQVKEADKALAAGKDAITKADDADKVSTAVTEHTPKIKAAHKTGDLKKAQVDANTALDKAAEKERGEINKDATLTTEDKAKQLKEVETALTKAKDNVKAAKTADAINDARDKGVATIDAVHKAGQDLGARKSGQVAKLEEAAKATKDKISADPTLTSKEKEEQSKAVDAELKKAIEAVNAADTADKVDDALGEGVTDIKNQHKSGDSIDARREAHGKELDRVAQETKGAIEKDPTLTTEEKAKQVKDVDAAKERGMAKLNEAKDADALDKAYGEGVTDIKNQHKSGDPVDARRGLHNKSIDEVAQATKDAITADTTLTEAEKETQRGNVDKEATKAKEELAKAKDADALDKAYGDGVTSIKNQHKSGKGLDVRKDEHKKALEAVAKRVTAEIEADPTLTPEVREQQKAEVQKELELATDKIAEAKDADEADKAYGDGVTAIENAHVIGKGIEARKDLAKKDLAEAAAKTKALIIEDKTLTDDQRKEQLLGVDTEYAKGIENIDAAKDAAGVDKAYSDGVRDILAQYKEGQNLNDRRNAAKEFLLKEADKVTKLINDDPTLTHDQKVDQINKVEQAKLDAIKSVDDAQTADAINDALGKGIENINNQYQHGDGVDVRKATAKGDLEKEAAKVKALIAKDPTLTQADKDKQTAAVDAAKNTAIAAVDKATTTEGINQELGKGITAINKAYRPGEGVKARKEAAKADLEKEAAKVKALITNDPTLTKADKAKQTEAVAKALKAAIAAVDKATTAEGINQELGKGITAINKAYRPGEGVKARKEAAKADLEREAAKVREAIANDPTLTKADKAKQTEAVAKALKAAIAAVDKATTAEGINQELGKGITAINKAYRPGEGVEAHKEAAKANLEKVAKETKALISGDRYLSETEKAVQKQAVEQALAKALGQVEAAKTVEAVKLAENLGTVAIRSAYVAGLAKDTDQATAALNEAKQAAIEALKQAAAETLAKITTDAKLTEAQKAEQSENVSLALKTAIATVRSAQSIASVKEAKDKGITAIRAAYVPNKAVAKSSSANHLPKSGDANSIVLVGLGVMSLLLGMVLYSKKKESKD

SEQ ID NO: 187 - protein, 910 aa, Streptococcus pyogenes
MINKKCIIPVSLLTLAITLTSVEEVTSRQNLTYANEIVTQRPKRESVISDKSNFPVISPYLASVDFGERKTPLPTPDKGVKVTTEQSIAQVRKGPEERPYTVTGKITSVINGWGGYGFYIQDSEGIGLYVYPQKDLGYSKGDIVQLTGTLTRFKGDLQLQQVTAHKKLELSFPTSVKEAVISELETTTPSTLVKLSHVTVGELSTDQYNNTSFLVRDDSGKSIVVHIDHRTGVKGADVVTKISQGDLINLTAILSIVDGQLQLRPFSLEQLEVVKKVTSSNSDASSRNIVKIGEIQGASHTSPLLKKAVTVEQVVVTYLDDSTHFYVQDLNGDGDLATSDGIRVFAKNAKVQVGDVLTISGEVEEFFGRGYEERKQTDLTITQIVAKAVTKTGTAQVPSPLVLGKDRIAPANIIDNDGLRVFDPEEDAIDYWESMEGMLVAVDDAKILGPMKNKEIYVLPGSSTRPLNNSGGVLLPANSYNTDVIPVLFKKGKQIIKAGDSYKGRLAGPVSYSYGNYKVFVDDSKNMPSLMDGHLKPEKTNLQKDLSKLSIASYNIENFSANPSSTKDEKVKRIAESFIHDLNAPDIIGLIEVQDNNGPTDDGTTDATQSAQRLIDAIKKLGGPTYRYVDIAPENNVDGGQPGGNIRTGFLYQPERVSLSDKPKGGARDALTWVNGELNLSVGRIDPTNAAWKDVRKSLAAEFIFQGRKVVVVANHLNSKRGDNALYGCVQPVTFKSEQRRHVLANMLAQFAKEGAKHQANIVMLGDFNDFEFTKTIQLIEEGDMVNLVSRHDISDRYSYFHQGNNQTLDNILVSRHLLDHYEFDMVHVNSPFMEAHGRASDHDPLLLQLSFSKENDKAESSKQSVKAKKTSKGKLLPKTGDSLVYVITLLGTASLLVPILLLTKGKKES

SEQ ID NO: 188 - protein, 1210 aa, Streptococcus pyogenes
VISFAPFLSPEAIKHLQENERCRDQSQKRTAQQIEAIYTSGQNILVSASAGSGKTFVMVERILDKILRGVSIDRLFISTFTVKAATELRERIENKLYSQIAQTTDFQMKVYLTEQLQSLCQADIGTMDAFAQKVVSRYGYSIGISSQFRIMQDKAEQDVLKQEVFSKLFNEFMNQKEAPVFRALVKNFSGNCKDTSAFRELVYTCYSFSQSTENPKIWLQENFLSAAKTYQRLEDIPDHDIELLLLAMQDTANQLRDVTDMEDYGQLTKAGSRSAKYTKHLTIIEKLSDWVRDFKCLYGKAGLDRLIRDVTGLIPSGNDVTVSKVKYPVFKTLHQKLKQFRHLETILMYQKDCFSLLEQLQDFVLAFSEAYLAVKIQESAFEFSDIAHFAIKILEENTDIRQSYQQHYHEVMVDEYQDNNHMQERLLTLLSNGHNRFMVGDIKQSIYRFRQADPQIFNQKFRDYQKKPEQGKVILLKENFRSQSEVLNVSNAVFSHLMDESVGDVLYDEQHQLIAGSHAQTVPYLDRRAQLLLYNSDKDDGNAPSDSEGISFSEVTIVAKEIIKLHNDKGVPFEDITLLVSSRTRNDIISHTFNQYGIPIATDGGQQNYLKSVEVMVMLDTLRTINNPRNDYALVALLRSPMFAFDEDDLARIALQKDNELDKDCLYDKIQRAVIGRGAHPELIHDTLLGKLNVFLKTLKSWRRYAKLGSLYDLIWKIFNDRFYFDFVASQAKAEQAQANLYALALRANQFEKSGYKGLYRFIKMIDKVLETQNDLADVEVATPKQAVNLMTIHKSKGLQFPYVFILNCDKRFSMTDIHKSFILNRQHGIGIKYLADIKGLLGETTLNSVKVSMETLPYQLNKQELRLATLSEEMRLLYVAMTRAEKKVYFIGKASKSKSQEITDPKKLGKLLPLALREQLLTFQDWLLAIADIFSTEDLYFDVRFIEDSDLTQESVGRLQTPQLLNPDDLKDNRQSETIARALDMLEAVSQLNANYEAAIHLPTVRTPSQLKATYEPLLEPIGVDIIEKSSRSLSDFTLPHFSKKAKVEASHIGSALHQLMQVLPLSKPINQQTLLDALRGIDSNEEVKTALDLKKIESFFCDTSLGQFFQTYQKHLYREAPFAILKLDPISQEEYVLRGIIDAYFLFDDHIVLVDYKTDKYKQPIELKKRYQQQLELYAEALTQTYKLPVTKRYLVLMGGGKPEIVEV

SEQ ID NO: 189 - protein, 253 aa, Streptococcus pyogenes
MVKTDFKLRYQGSAIGYLWSILKPLMMFTIMYLVFIRFLRLGGNVPHFPVALLLANVIWSFFSEATSMGMVSIVSRGDLLRKLNFSKHIIVFSAVLGALINFLINLVVVLIFALINGVTISGYAYLSLFLFIELVVLVLGIALLLSNVFVYYRDLAQVWEVLLQAGMYATPIIYPITFVLDSHPLAAKLLMLNPVAQMIQDFRYLLIDRANVTIWQMSTNWFYIVIPYLVPFVILFIGIFVFKKNADRFAEII

SEQ ID NO: 190 - protein, 577 aa, Streptococcus pyogenes
MTFLSDLISLMTKIRLSWVIKAGIFQLLFVTIANIVLSEFFYFILDVTGQYHLDKDNVVTFLKNPIALALLGAYLFLLAAFIHLEFFALYRIIADQEISFYLFRKQFSYYLRGLWKTFSGYQLLLFLLYILLTIPVLHIGLSSVITQKLYLPEFIVGELSKITSTKYLLYGSLILVFYLNLRLVYFLPLIAINHRTVAQAWRESWQKTKKKHVLLWMKLFAINGLTIVVLSLAISMILIFVDMFNPKGNNIIVQLGALTFTWELIFFTTIFFKLCSAMILKEAIEPQKQYDEPRRSNKAYVVIFIVVTVGFAYQSLERLTFFDTSHSKTVIAHRGLVSAGVENSLEALEGAKKAGSDYVELDLILTKDNHFVVSHDNRLKRLAGVNKTIRNLTLKEVEHLTSHQGHFSGRFVSFDTFYQKAKKLNMPLLIELKPIGTEPGNYVDLFLETYHRLGISKDNKVMSLDLEVIEAIKKKNPSITTGYIIPIQFGFFGDEFVDFYVIEDFSYRSYLSSQAFWNNKEIYVWTINDPKRIEHYLLKPIQGIITDQPALTNQLIKDLKQDNSYFSRLVRIISSLY

SEQ ID NO: 191 - protein, 1008 aa, Streptococcus pyogenes
MKKHLKTVALTLTTVSVVTHNQEVFSLVKEPILKQTQASSSISGADYAESSGKSKLKINETSGPVDDTVTDLFSDKRTTPEKIKDNLAKGPREQELKAVTENTESEKQITSGSQLEQSKESLSLNKTVPSTSNWEICDFITKGNTLVGLSKSGVEKLSQTDHLVLPSQAADGTQLIQVASFAFTPDKKTAIAEYTSRAGENGEISQLDVDGKEIINEGEVFNSYLLKKVTIPTGYKHIGQDAFVDNKNIAEVNLPESLETISDYAFAHLALKQIDLPDNLKAIGELAFFDNQITGKLSLPRQLMRLAERAFKSNHIKTIEFRGNSLKVIGEASFQDNDLSQLMLPDGLEKIESEAFTGNPGDDHYNNRVVLWTKSGKNPSGLATENTYVNPDKSLWQESPEIDYTKWLEEDFTYQKNSVTGFSNKGLQKVKRNKNLEIPKQHNGVTITEIGDNAFRNVDFQNKTLRKYDLEEVKLPSTIRKIGAFAFQSNNLKSFEASDDLEEIKEGAFMNNRIETLELKDKLVTIGDAAFHINHIYAIVLPESVQEIGRSAFRQNGANNLIFMGSKVKTLGEMAFLSNRLEHLDLSEQKQLTEIPVQAFSDNALKEVLLPASLKTIREEAFKKNHLKQLEVASALSHIAFNALDDNDGDEQFDNKVVVKTHHNSYALADGEHFIVDPDKLSSTIVDLEKILKLIEGLDYSTLRQTTQTQFRDMTTAGKALLSKSNLRQGEKQKFLQEAQFFLGRVDLDKAIAKAEKALVTKKATKNGQLLERSINKAVLAYNNSAIKKANVKRLEKELDLLTGLVEGKGPLAQATMVQGVYLLKTPLPLPEYYIGLNVYFDKSGKLIYALDMSDTIGEGQKDAYGNPILNVDEDNEGYHALAVATLADYEGLDIKTILNSKLSQLTSIRQVPTAAYHRAGIFQAIQNAAAEAEQLLPKPGTHSEKSSSSESANSKDRGLQSNPKTNRGRHSAILPRTGSKGSFVYGILGYTSVALLSLITAIKKKKY

SEQ ID NO: 192 - protein, 670 aa, Streptococcus pyogenes
MKKYFILKSSVLSILTSFTLLVTDVQADQVDVQFLGVNDFHGALDNTGTAYTPSGKIPNAGTAAQLGAYMDDAEIDFKQANQDGTSIRVQAGDMVGASPANSALLQDEPTVKVFNKMKFEYGTLGNHEFDEGLDEFNRIMTGQAPDPESTINDITKQYEHEASHQTIVIANVIDKKTKDIPYGWKPYAIKDIAINDKIVKIGFIGVVTTEIPNLVLKQNYEHYQFLDVAETIAKYAKELQEQHVHAIVVLAHVPATSKDGVVDHEMATVMEKVNQIYPEHSIDIIFAGHNHQYTNGTIGKTRIVQALSQGKAYADVRGTLDTDTNDFIKTPSANVVAVAPGIKTENSDIKAIINHANDIVKTVTERKIGTATNSSTISKTENIDKESPVGNLATTAQLTIAKKTFPTVDFAMTNNGGIRSDLVVKNDRTITWGAAQAVQPFGNILQVIQMTGQHIYDVLNQQYDENQTYFLQMSGLTYTYTDNDPKNSDTPFKIVKVYKDNGEEINLTTTYTVVVNDFLYGGGDGFSAFKKAKLIGAINTDTEAFITYITNLEASGKTVNATIKGVKNYVTSNLESSTKVNSAGKHSIISKVFRNRDGNTVSSEVISDLLTSTENTNNSLGKKETTTNKNTISSSTLPITGDNYKMSPIMTILALISLGGLNAFIKKRKS

SEQ ID NO: 193 - protein, 262 aa, Streptococcus pyogenes
MTNNQTLDILLDVYAYNHAFRIAKALPNIPKTALYLLEMLKERRELNLAFLAEHAAENRTIEDQYHCSLWLNQSLEDEQIANYILDLEVKVKNGAIIDFVRSVSPILYRLFLRLITSEIPNFKAYIFDTKNDQYDTWHFQAMLESDHEVFKAYLSQKQSRNVTTKSLADMLTLTSLPQEIKDLVFLLRHFEKAVRNPLAHLIKPFDEEELHRTTHFSSQAFLENIITLATFSGVIYRREPFYFDDMNAIIKKELSLWRQSIV

SEQ ID NO: 194 - protein, 429 aa, Streptococcus pyogenes
MKTTSLIKVDLPSTIGIGYGAFWRSRNFYRVVKGSRGSKKSKTTALNFIVRLLKYPWANLLVIRRYSNTNKQSTYTDFKWACNQLKVTHLFKFNESLPEITVKATGQKILFRGLDDELKITSITVDVGALCWAWFEEAYQIETEDKFSTVVESIRGSLDAPDFFKQITVTFNPWSERHWLKRVFFDEETKRADTFSGTTTFRVNEWLDDVDKRRYEDLYKTNPRRARIVCDGEWGVAEGLVFDNFEVVDFDVEKTIQRVKETSAGMDFGFTQDPTTLICVAVDLANKELWLYNEHYQKAMLTDHIVKMIRDKNLHRSYIAGDSAEKRLIAEIKSKGVSGIVPSIKGKGSIMQGIQFMQGFKIYIHPSCEHTIEEFNTYTFKQDKEGNWLNEPIDKNNHVIDAIRYALEKYHIRSNESNQFEVLRAGFGY

SEQ ID NO: 195 - protein, 177 aa, Streptococcus pyogenes
MAEETQTVETVEEQVVPEAKQPQDEKKYTDADVDAIIDKKFAKWKSEQEAEKSEAKKMAKMNEKEKADYEKQKLLDELQELKNDKTRNELTAVARQMFAESEINVNDDVLGLVVTLDAEQTKANVTTLANAFAKVIADDRKALVRQTTPSTGGGLSKQTNYGANLASKAAQQSTKLF

SEQ ID NO: 196 - protein, 236 aa, Streptococcus pyogenes
MRYNCRYSHIDKKIYSMIICLSFLLYSNVVQANSYNTTNRHNLESLYKHDSNLIEADSIKNSPDIVTSHMLKYSVKDKNLSVFFEKDWISQEFKDKEVDIYALSAQEVCECPGKRYEAFGGITLTNSEKKEIKVPVNVWDKSKQQPPMFITVNKPKVTAQEVDIKVRKLLIKKYDIYNNREQKYSKGTVTLDLNSGKDIVFDLYYFGNGDFNSMLKIYSNNERIDSTQFHVDVSIS

SEQ ID NO: 197 - protein, 805 aa, Streptococcus pyogenes
VNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 198 - protein, 293 aa, Streptococcus pyogenes
LLTFGGASAVKAEENEKVREQEKLIQQLSEKLVEINDLQTLNGDKESIQSLVDYLTRRGKLEEEWMEYLNSGIQRKLFVGPKGPAGEKGEQGPTGKQGERGETGPAGPRGDKGETGDKGAQGPVGPAGKDGQNGKDGLPGKDGKDGQNGKDGLPGKDGKDGQDGKDGLPGKDGKDGQNGKDGLPGKDGQPGKPAPKTPEVPQNPDTAPHTPKTPRIPGQSKDVTPAPQNPSNRGLNKPQTQGGNQLAKTPAAHDTHRQLPATGETTNPFFTAAAVAIMTTAGVVAVAKRQENN

SEQ ID NO: 199 - protein, 323 aa, Streptococcus pyogenes
MYIFSSSKKDSAKELVILTPNSQTILTGTIPAFEEKYGVKVRLIQGGTGQLIDQLGRKDKPLNADIFFGGNYTQFESHKDLFESYVSPQVSTVISDYQLPSHRATPYTINGSVLIVNNELARGLHITSYEDLLQPALKGKIAFADPNSSSSAFSQLTNILLAKGGYTNADAWAYMKRLLVNMNSIRATSSSEVYQSVAEGKMIVGLTYEDPCINLQKSGANVSIVYPKEGTVFVPSSVAIIKHAPNMTEAKLFINFMLSRDVQNAFGQSTSNRPIRQDAQTSHDMKALETIATLKEDYAYVTKHKKKIVATYNQLRQRLEKAK

SEQ ID NO: 200 - protein, 263 aa, Streptococcus pyogenes
MPTSIKAIKESLEAVTSLLDPLFQELATDTRSGVQKALKSRQKVIQAELAEEERLEAMLSYEKALYKKGYKAIAGIDEVGRGPLAGPVVAACVILPKYCKIKGLNDSKKIPKAKHETIYQAVKEKALAIGIGIIDNQLIDEVNIYEATKLAMLEAIKQLEGQLTQPDYLLIDAMTLDIAISQQSILKGDANSLSIAAASIVAKVTRDQMMANYDRIFPGYDFAKNAGYGTKEHLQGLKAYGITPIHRKSFEPVKSMCCDSTNP

SEQ ID NO: 201 - protein, 521 aa, Streptococcus pyogenes
MTVKEETMSILEVKQLSHGFGDRAIFENVSFRLLKGEHIGLVGANGEGKSTFMSIVTGHLQPDEGKVEWSKYVTAGYLDQHTVLESGQTVRDVLRTAFDELFKTENRINEIYASMADDKADIAVLMEEVGELQDRLESRDFYTLDAKIDEVARALGVMDFGMESDVTSLSGGQRTKVLLAKLLLEKPDILLLDEPTNHLDAEHIEWLKRYLQHYENAFVLISHDISFLNDVINIVYHVENQSLVRYTGDYYQFQAVYEMKQSQLEAAYERQQKEIANLQDFVNRNKARVATRNMAMSRQKKLDKMDIIELQAEKPKPNFEFKQARTPSRFIFQTKNLVIGYDYPLTKEPLNITFERNQKIAIVGANGIGKSTLLKSLLGVIEPLEGHIVTGDFLEVGYFEQEVTGVNRQTPLEVVWDAFPALNQAEVRAALARCGLTSKHIESQIQVLSGGEQAKVRFCLLMNRENNVLILDEPTNHLDIDAKNELKRALKAYKGSILMVCHEPDFYNGWVTDTWDFSKLT

SEQ ID NO: 202 - protein, 350 aa, Streptococcus pyogenes
MNKKFIGLGLASVAVLSLAACGNRGASKGGASGKTDLKVAMVTDTGGVDDKSFNQSAWEGLQSWGKEMGLQKGTGFDYFQSTSESEYATNLDTAVSGGYQLIYGIGFALKDAIAKAAGDNEGVKFVIIDDIIEGKDNVASVTFADHEAAYLAGIAAAKTTKTKTVGFVGGMEGTVITRFEKGFEAGVKSVDDTIQVKVDYAGSFGDAAKGKTIAAAQYAAGADVIYQAAGGTGAGVFNEAKAINEKRSEADKVWVIGVDRDQKDEGKYTSKDGKEANFVLASSIKEVGKAVQLINKQVADKKFPGGKTTVYGLKDGGVEIATTNVSKEAVKAIKEAKAKIKSGDIKVPEK

SEQ ID NO: 203 - protein, 288 aa, Streptococcus pyogenes
MKMKKKFFLLSLLALSTFFLSACSSWIDKGESITAVGSTALQPLVEAVADEFGSSNLGKTVNVQGGGSGTGLSQVQSGAVQIGNSDVFAEEKDGIDASKLVDHQVAVAGLAVIANPKVKVSNLSSQQLQKIFSGEYTNWKQVGGEDLAISVINRAASSGSRATFDSVIMKGVNAKQSQEQDSNGMVKSIVSQTPGAISYLSFAYVDSSVKSLQLNGFKANAKNVATNDWPIWSYEHMYTKDKPTGLTKEFLDYMFSDEVQQNIVTHMGYISINDMEVVKSHDGKVTKR

SEQ ID NO: 204 - protein, 724 aa, Streptococcus pyogenes
MTHKIKVLLLAIMSIFLTCNIASAETIAIVSDTAYAPFEFKDSDQIYKGIDVDIINEVAKRQSWDFSMSFPGFDAAVNAVQSGQASALMAGTTITNARKKVFHFSEPYYDTKIVIATRKANAIKKYSDLKGKTVGVKNGTAAQAFLNNYKKKYDYTVKTFDTGDLMYNSLSAGSIAAVMDDEAVIQYAISQNQDIAINMKGEPIGSFGFAVKKGSGYDYLVNDFNTALKAMKADGTYQAIMTKWLGTDDKATTSQATGNPSAKATPTKDSYKIVSDSSFAPFEFQNGKGKYVGIDIELIKAIAKQQGFKIEIANPGFDAALNAVQSSQADGVIAGATITDARKAIFDFSDPYYTSNIILAVKAGKNIKNYEDLDRKTVGAKNGTSSYSWLKENAPKYGYNVKAFDDGSSMYDSLNSGSVDAIMDDEAVLKYAISQGRRFETPLEGISTGEVGFAVKKGTNPELIEMFNNGLAALKKSGQYDDIIDKYLDSKKAATPSEKGADESTISGLLSNNYKQLLAGLGTTLSLTLISFAIAIIIGIIFGMMAVSPTKSLRLISTVFVDVVRGIPLMIVAAFIFWGVPNLIESMTGHQSPINDFLAATIALSLNGGAYIAEIVRGGIEAVPAGQMEASRSLGLSYGTTMRKVILPQAVKLMLPNFINQFVISLKDTTIVSAIGLVELFQTGKIIIARNYQSFRMYAILAIIYLIMIILLTRLAKRLEKRLN

SEQ ID NO: 205 - protein, 217 aa, Streptococcus pyogenes
MGKEIKVKCFLRRSAFGLVAVSASVLVGSTVSAVDSPIEQPRIIPNGGTLTNLLGNAPEKLALRNEERAIDELKKQAIEDKEATTAIEAASSDALEALADQTDALQSEEAAVVKADNAASDALEALADQTDALQSEEAEVVQSDNAASDAWEKAATPIALDVKKTKDTKPVVKKEERQNVNTLPTTGEESNPFFTAAALAIMVSTGVLVVSSKCKEN

SEQ ID NO: 206 - protein, 792 aa, Streptococcus pyogenes
MKTKKVIILVGLLLSSQLTLIACQSRGNGTYPIKTKQSRKGMTSNKIKPIKKSKKTNKTHKGVAGVDFPTDDGFILTKDSKILSKTDQGIVVDHDGHSHFIFYADLKGSPFEYLIPKGASLAKPAVAQRAASQGTSKVADPHHHYEFNPADIVAEDALGYTVRHDDHFHYILKSSLSGQTQAQAKQVATRLPQTSSLVSTATANGIPGLHFPTSDGFQFNGQGIVGVTKDSILVDHDGHLHPISFADLRQGGWAHVADQYDPAKKAEKPAETHQTPELSEREKEYQEKLAYLAEKLGIDPSTIKRVETQDGKLGLEYPHHDHAHVLMLSDIEIGKDIPDPHAIEHARELEKHKVGMDTLRALGFDEEVILDIVRTHDAPTPFPSNEKDPNMMKEWLATVIKLDLGSRKDPLQRKGLSLLPNLETLGIGFTPIKDISPVLQFKKLKQLLMTKTGVTDYRFLDNMPQLEGIDISQNNLKDISFLSKYKNLTLVAAADNGIEDIRPLGQLPNLKFLVLSNNKISDLSPLASLHQLQELHIDNNQITDLSPVSHKESLTVVDLSRNADVDLATLQAPKLETLMVNDTKVSHLDFLKNNPNLSSLSINRAQLQSLEGIEASSVIVRVEAEGNQIKSLVLKDKQGSLTFLDVTGNQLTSLEGVNNFTALDILSVSKNQLTNVNLSKPNKTVTNIDISHNNISLADLKLNEQHIPEAIAKNFPAVYEGSMVGNGTAEEKAAMATKAKESAQEASESHDYNHNHTYEDEEGHAHEHRDKDDHDHEHEDENEAKDEQNHAD

SEQ ID NO: 207 - protein, 475 aa, Streptococcus pyogenes
LAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVSFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 208 - protein, 719 aa, Streptococcus pyogenes
MSLKDLGDISYFRLNNEINRPVNGKIPLHKDKEALKAFSAENVLPNTMSFTSITEKIEYLISNDYIESAFIQKYRPEFITELDSIIKSENFRFKSFMAAYKFYQQYALKTNDGEHYLENLEDRVLFNALYFADGQEDLAKDLAVEMINQRYQPATPSFLNAGRSRRGELVSCFLIQVTDDMNSIGRSINSALQLSRIGGGVGITLSNLREAGAPIKGYAGAASGVVPVMKLFEDSFSYSNQLGQRQGAGVVYLNVFHPDIIAFLSTKKENADEKVRVKTLSLGITVPDKFYELARKNEDMYLFSPYNVEKEYGIPFNYLDITNMYDELVANPKITKTKIKARDLETEISKLQQESGYPYIINIDTANKANPIDGKIIMSNLCSEILQVQTPSLINDAQEFVEMGTDISCNLGSTNILNMMTSPDFGRSIKTMTRALTFVTDSSSIEAVPTIKHGNSQAHTFGLGAMGLHSYLAQHHIEYGSPESIEFTDIYFMLLNYWTLVESNNIARERQTTFVGFENSKYANGSYFDKYVTGHFVPKSDLVKDLFKDHFIPQASDWEALRDAVQKDGLYHQNRLAVAPNGSISYINDCSASIHPITQRIEERQEKKIGKIYYPANGLSTDTIPYYTSAYDMDMRKVIDVYAAATEHVDQGLSLTLFLRSELPMELYEWKTQSKQTTRDLSILRNYAFNKGIKSIYYIRTFTDDGEEVGANQCESCVI

SEQ ID NO: 209 - protein, 872 aa, Streptococcus pyogenes
MKELSSAQIRQMWLDFWKSKGHCVEPSANLVPVNDPTLLWINSGVATLKKYFDGSVIPENPRITNAQKSIRTNDIENVGKTARHHTMFEMLGNFSIGDYFRDEAIEWGFELLTSPDWFDFPKDKLYMTYYPDDKDSYNRWIACGVEPSHLVPIEDNFWEIGAGPSGPDTEIFFDRGEDFDPENIGLRLLAEDIENDRYIEIWNIVLSQFNADPAVPRSEYKELPNKNIDTGAGLERLAAVMQGAKTNFETDLFMPIIREVEKLSGKTYDPDGDNMSFKVIADHIRALSFAIGDGALPGNEGRGYVLRRLLRRAVMHGRRLGINETFLYKLVPTVGQIMESYYPEVLEKRDFIEKIVKREEETFARTIDAGSGHLDSLLAQLKAEGKDTLEGKDIFKLYDTYGFPVELTEELAEDAGYKIDHEGFKSAMKEQQDRARAAVVKGGSMGMQNETLAGIVEESRFEYDTYSLESSLSVIIADNERTEAVSEGQALLVFAQTPFYAEMGGQVADTGRIKNDKGDTVAEVVDVQKAPNGQPLHTVNVLASLSVGTNYTLEINKERRLAVEKNHTATHLLHAALHNVIGEHATQAGSLNEEEFLRFDFTHFEAVSNEELRHIEQEVNEQIWNALTITTTETDVETAKEMGAMALFGEKYGKVVRVVQIGNYSVELCGGTHLNNSSEIGLFKIVKEEGIGSGTRRIIAVTGRQAFEAYRNQEDALKEIAATVKAPQLKDAAAKVQALSDSLRDLQKENAELKEKAAAAAAGDVFKDVQEAKGVRFIASQVDVADAGALRTFADNWKQKDYSDVLVLVAAIGEKVNVLVASKTKDVHAGNMIKELAPIVAGRGGGKPDMAMAGGSDASKIAELLAAVAEIV

SEQ ID NO: 210 - protein, 351 aa, Streptococcus pyogenes
MKNSNKLIASVVTLASVMALAACQSTNDNTKVISMKGDTISVSDFYNETKNTEVSQKAMLNLVISRVFEAQYGDKVSKKEVEKAYHKTAEQYGASFSAALAQSSLTPETFKRQIRSSKLVEYAVKEAAKKELTTQEYKKAYESYTPTMAVEMITLDNEETAKSVLEELKAEGADFTAIAKEKTTTPEKKVTYKFDSGATNVPTDVVKAASSLNEGGISDVISVLDPTSYQKKFYIVKVTKKAEKKSDWQEYKKRLKAIIIAEKSKDMNFQNKVIANALDKANVKIKDKAFANILAQYANLGQKTKAASESSTTSESSKAAEENPSESEQTQTSSAEEPTETEAQTQEPAAQ

SEQ ID NO: 211 - protein, 198 aa, Streptococcus pyogenes
VLYPTPIAKLIDSYSKLPGIGIKTATRLAFYTIGMSNEDVNDFAKNLLAAKRELTYCSICGNLTDDDPCHICTDTSRDQTTILVVEDAKDVSAMEKIQEYHGYYHVLHGLISPMNGVGPDDINLKSLITRLMDGKVSEVIVATNATADGEATSMYISRVLKPAGIKVTRLARGLAVGSDIEYADEVTLLRAIENRTEL

SEQ ID NO: 212 - protein, 268 aa, Streptococcus pyogenes
MDMSKSNRRTWQGLVVILIAILTTFTTSTVTAARKIRNFPDTTEILLGTKATETPGILPFTGSYQLVLGDLDNLQRPTFAHIQLKDQDEPNIKRKGLKFNPPGWHNYKLTDANGKTTWLMDRGHLVGYQFSGLNDEPKNLVTMTKYLNTGFSDKNPLGMLYYENRLDSWLALHPNFWLDYKVTPVYHKNELVPRQVVLQYVGIDENGDLLQIKLGSEKESVDNFGVTSVTLDNVSPLAELDYQTGMMLDSTQNEEDSNLETEEFEEAA

SEQ ID NO: 213 - protein, 313 aa, Streptococcus pyogenes
MTSKKACLSSIIVLASLTCGNDTVSANHLSATGDKFDDCSTLVEKDVAPKDELEMLAWSSSQTTDDADRDYEDFLDDDSFISQNETDKMFENLTDDRLLNELDELDEENEEDEEDTIEPEQNVIMPSDDELFDLTDAVETRLTVSSAPHLEAELPKPHLRSLSDTALRSGEIRGHLDNKLDALSVTATKLALTMAQKFDLTTHVYSIGESFSEVLAAHYEDRKAESAFSKKKRFHLPIATPDVVIEELRRLVSSIGSSKEDVSVPYSRKLGMAVAKRKIALPQTGERFSYYPVLLGLMILGLTPIMIPKKINN

SEQ ID NO: 214 - protein, 382 aa, Streptococcus pyogenes
MAKDKEKQSDDKLVLTEWQKRNIEFLKKKKQQAEEEKKLKEKLLSDKKAQQQAQNASEAVELKTDEKTDSQEIESETTSKPKKTKKVRQPKEKSATQIAFQKSLPVLLGALLLMAVSIFMITPYSKKKEFSVRGNHQTNLDELIKASKVKASDYWLTLLTSPGQYERPILRTIPWVKSVHLSYQFPNHFLFNVIEFEIIAYAQVENGFQPILENGKRVDKVRASELPKSFLILNLKDEKAIQQLVKQLTTLPKKLVKNIKSVSLANSKTTADLLLIEMHDGNVVRVPQSQLTLKLPYYQKLKKNLENDSIVDMEVGIYTTTQEIENQPEVPLTPEQNAADKEGDKPGEHQEQTDNDSETPANQSSPQQTPPSPETVLEQAHG

SEQ ID NO: 215 - protein, 345 aa, Streptococcus pyogenes
MKRLKKIKWWLVGLLALISLLLALFFPLPYYIEMPGGAYDIRTVLQVNGKEDKRKGAYQFVAVGISRASLAQLLYAWLTPFTEISTAEDTTGGYSDADFLRINQFYMETSQNAAIYQALSLAGKPVTLDYKGVYVLDVNNESTFKGTLHLADTVTGVNGKQFTSSAELIDYVSHLKLGDEVTVQFTSDNKPKKGVGRIIKLKNGKNGIGIALTDHTSVNSEDTVIFSTKGVGGPSAGLMFTLDIYDQITKEDLRKGRTIAGTGTIGKDGEVGDIGGAGLKVVAAAEAGADIFFVPNNPVDKEIKKVNPNAISNYEEAKRAAKRLKTKMKIVPVTTVQEALVYLRK

SEQ ID NO: 216 - protein, 282 aa, Streptococcus pyogenes
MLEHKIDFMVTLEVKEANANGDPLNGNMPRTDAKGYGVMSDVSIKRKIRNRLQDMGKSIFVQANERIEDDFRSLEKRFSQHFTAKTPDKEIEEKANALWFDVRAFGQVFTYLKKSIGVRGPVSISMAKSLEPIVISSLQITRSTNGMEAKNNSGRSSDTMGTKHFVDYGVYVLKGSINAYFAEKTGFSQEDAEAIKEVLVSLFENDASSARPEGSMRVCEVFWFTHSSKLGNVSSARVFDLLEYHQSIEEKSTYDAYQIHLNQEKLAKYEAKGLTLEILEGL

SEQ ID NO: 217 - protein, 901 aa, Streptococcus pyogenes
MATKKVHIISHSHWDREWYMAYEQHHMRLINLIDDLLEVFQTDPDFHSFHLDGQTIILDDYLKVRPEREPEIRQAIASGKLRIGPFYILQDDFLTSSESNVRNMLIGKEDCDRWGASVPLGYFPDTFGNMGQTPQLMLKAGLQAAAFGRGIRPTGFNNQVDTSEKYSSQFSEISWQGPDNSRILGLLFANWYSNGNEIPTTEAEARLFWDKKLADAERFASTKHLLMMNGCDHQPVQLDVTKAIALANQLYPDYEFVHSCFEDYLADLADDLPENLSTVQGEITSQETDGWYTLANTASARIYLKQANTRVSRQLENITEPLAAMAYEVTSTYPHDQLRYAWKTLMQNHPHDSICGCSVDSVHREMMTRFEKAYEVGHYLAKEAAKQIADAIDTRDFPMDSQPFVLFNTSGHSKTSVAELSLTWKKYHFGQRFPKEVYQEAQEYLARLSQSFQIIDTSGQVRPEAEILGTSIAFDYDLPKRSFREPYFAIKVRLRLPITLPAMSWKTLALKLGNETTPSETVSLYDDSNQCLENGFLKVMIQTDGRLTITDKQSGLIYQDLLRFEDCGDIGNEYISRQPNHDQPFYADQGTIKLNIISNTAQVAELEIQQTFAIPISADKLLQAEMEAVIDITERQARRSQEKAELTLTTLIRMEKNNPRLQFTTRFDNQMTNHRLRVLFPTHLKTDHHLADSIFETVKRPNHPDATFWKNPSNPQHQECFVSLFDGENGVTIGNYGLNEYEILPDTNTIAITLLRSVGEMGDWGYFPTPEAQCLGKHSLSYSFESITKQTQFASYWRAQEGQVPVITTQTNQHEGTLAAEYSYLTGTNDQVALTAFKRRLADNALITRSYNLSNDKTCDFSLSLPNYNAKVTNLLEKDSKQSTPSQLGKAEILTLAWKKQ

SEQ ID NO: 218 - protein, 258 aa, Streptococcus pyogenes
MKITKIEKKKRLYLIELDNDESLYVTEDTIVRFMLSKDKVLDNDQLEDMKHFAQLSYGKNLALYFLSFQQRSNKQVADYLRKHEIEEHIIADIITQLQEEQWIDDTKLADTYIRQNQLNGDKGPQVLKQKLLQKGIASHDIDPILSQTDFSQLAQKVSQKLFDKYQEKLPPKALKDKITQALLTKGFSYDLAKHSLNHLNFDQDNQEIEDLLDKELDKQYRKLSRKYDGYTLKQKLYQALYRKGYNSDDINCKLRNYL

SEQ ID NO: 219 - protein, 221 aa, Streptococcus pyogenes
MICLLCQQISQTPISITEIIFLRRISSPICQQCQKSFQKIGKSVCATCCANSDIIACRDCLKWENKGYNVNHRSLYCYNAAMKAYFSQYKFQGDYLLRKVFAVELADVITKYYKGYIPVPVPVSPGCFRERQFNQVSAILEAANVSYLSLFEKLDNTHQSSRTKKERLLVEKSYRLLKVSNIPDKILIVDDIYTTGSTIIALRKQLAKVANSDIKSLSIAR

SEQ ID NO: 220 - protein, 337 aa, Streptococcus pyogenes
MKSFSLTFSFLNLLKYGTIKVMTKEFHHVTVLLHETVDMLDIKPDGIYVDATLGGSGHSAYLLSKLGEEGHLYCFDQDQKAIDNAQVTLKSYIDKGQVTFIKDNFRHLKARLTALGVDEIDGILYDLGVSSPQLDERERGFSYKQDAPLDMRMDRQSLLTAYEVVNTYPFNDLVKIFFKYGEDKFSKQIARKIEQARAIKPIETTTELAELIKAAKPAKELKKKGHPAKQIFQAIRIEVNDELGAADESIQDAMELLALDGRISVITFHSLEDRLTKQLFKEASTVDVPKGLPLIPEDMKPKFELVSRKPILPSHSELTANKRAHSAKLRVAKKIRK

SEQ ID NO: 221 - protein, 263 aa, Streptococcus pyogenes
VTTTEQELTLTPLRGKSGKAYKGTYPNGECVFIKLNTTPILPALAKEQIAPQLLWAKRMGNGDMMSAQEWLNGRTLTKEDMNSKQIIHILLRLHKSKKLVNQLLQLNYKIENPYDLLVDFEQNAPLQIQQNSYLQAIVKELKRSLPEFKSEVATIVHGDIKHSNWVITTSGMIFLVDWDSVRLTDRMYDVAYLLSHYIPRSRWSEWLSYYGYKNNDKVMQKIIWYGQFSHLTQILKCFDKRDMEHVNQEIYALRKFREIFRKK

SEQ ID NO: 222 - protein, 671 aa, Streptococcus pyogenes
MILTAPMSNLKGFGPKSAEKFQKLDIYTVEDLLLYYPFRYEDFKSKSVFDLVDGEKAVITGLVVTPANVQYYGFKRNRLSFKLRQGEAVLNVSFFNQPYLADKIELGQEVAVFGKWDATKSAITGMKVLAQVEDDMQPVYRVAQGISQSTLIKAIKSAFEIDAHLELKENLPATLLEKYRLMGRSQACLAMHFPKDITEYKQALRRIKFEELFYFQMNLQVLKAENKSETNGLPILYSKRAMETKISSLPFILTNAQKRSLDDILSDMSSGAHMNRLLQGDVGSGKTVIAGLSMYAAYTAGFQSALMVPTEILAEQHYISLQELFPDLSIAILTSGMKAAVKRTVLAAIANGSVDMIVGTHALIQDSVQYHKLGLVITDEQHRFGVKQRRIFREKGENPDVLMMTATPIPRTLAITAFGEMDVSIIDELPAGRKPIMTRWVKHEQLGTVLEWVKGELQKDAQVYVISPLIEESEALDLKNAVALHAELSTYFEGIAKVALVHGRMKNDEKDAIMQDFKDKKSHILVSTTVIEVGVNVPNATIMIIMDADRFGLSQLHQLRGRVGRGYKQSYAVLVANPKTDSGKKRMTIMTETTDGFVLAESDLKMRGSGEIFGTRQSGIPEFQVADIVEDYPILEEARKVSAAIVSDPNWIYEKQWQLVAQNIRKKEVYD

SEQ ID NO: 223 - protein, 1275 aa, Streptococcus pyogenes
MKKISKCAFVAISALVLIQATQTVKSQEPLVQSQLVTTVALTQDNRLLVEEIGPYASQSAGKEYYKHIEKIIVDNDVYEKSLEGERTFDINYQGIKINADLIKDGKHELTIVNKKDGDILITFIKKGDKVTFISAQKLGTTDHQDSLKKDVLSDKTVPQNQGTQKVVKSGKNTANLSLITKLSQEDGAILFPEIDRYSDNKQIKALTQQITKVTVNGTVYKDLISDSVKDTNGWVSNMTGLHLGTKAFKDGENTIVISSKGFEDVTITVTKKDGQIHFVSAKQKQHVTAEDRQSTKLDVTTLEKAIKEADAIIAKESNKDAVKDLAEKLQVIKDSYKEIKDSKLLADTHRLLKDTIESYQAGEVSINNLTEGTYTLNFKANKENSEESSMLQGAFDKRAKLVVKADGTMEISMLNTALGQFLIDFSIESKGTYPAAVRKQVGQKDINGSYIRSEFTMPIDDLDKLHKGAVLVSAMGGQESDLNHYDKYTKLDMTFSKTVTKGWSGYQVETDDKEKGVGTERLEKVLVKLGKDLDGDGKLSKTELEQIRGELRLDHYELTDISLLKHAKNITELHLDGNQITEIPKELFSQMKQLRFLNLRSNHLTYLDKDTFKSNAQLRELYLSSNFIHSLEGGLFQSLHHLEQLDLSKNRIGRLCDNPFEGLSRLTSLGFAENSLEEIPEKALEPLTSLNFIDLSQNNLALLPKTIEKLRALSTIVASRNHITRIDNISFKNLPKLSVLDLSTNEISNLPNGIFKQNNQLTKLDFFNNLLTQVEESVFPDVETLNLDVKFNQIKSVSPKVRALIGQHKLTPQKHIAKLEASLDGEKIKYHQAFSLLDLYYWEQKTNSAIDKELVSVEEYQQLLQEKGSDTVSLLNDMQVDWSIVIQLQKKASNGQYVTVDEKLLSNDPKDDLTGEFSLKDPGTYRIRKALITKKFATQKEHIYLTSNDILVAKGPHSHQKDLVENGLRALNQKQLRDGIYYLNASMLKTDLASESMSNKAINHRVTLVVKKGVSYLEVEFRGIKVGKMLGYLGELSYFVDGYQRDLAGKPVGRTKKAEVVSYFTDVTGLPLADRYGKNYPKVLRMKLIEQAKKDGLVPLQVFVPIMDAISKGSGLQTVFMRLDWASLTTEKAKVVKETNNPQENSHLTSTDQLKGPQNRQQEKTPTSPPSAATGIANLTDLLAKKATGQSTQETSKTDDTDKAEKLKQLVRDHQTSIEGKTAKDTKTKKSDKKHRSNQQSNGEESSSRYHLIAGLSSFMIVALGFIIGRKTLFK

SEQ ID NO: 224 - protein, 503 aa, Streptococcus pyogenes
MNKNKLLRVAMLLSLLAPTAESMTVLAQDVMLETHKATTNETSDSSSKEENNKNAAPTTSDKTDQGPLDASAETNSNSLVNADDKKRSDSSQSAIGSSDNKAEAENQVDDKSTDHSKSTDHSKPTDQPKPSPSKVDTAPASSLSKQLPEARTPIQSLSPYVSDLDLSEIDIPSVNTYAAYVEHWSGKNAYTHHLLSRRYGIKADQIDSYLKSTGIAYDSTRINGEKLLQWEKKSGLDVRAIVAIAMSESSLGTQGIATLLGANMFGYAAFDLDPTQASKFNDDSAIVKMTQDTIIKNKNSNFALQDLKAAKFSRGQLNFASDGGVYFTDTTGSGKRRAQIMEDLDKWIDDHGGTPAIPAELKVQSSASFASVPAGYKLSKSYDVLGYQASSYAWGQCTWYVYNRAKELGYQFDPFMGNGGDWKYKVGYALSKTPKVGYAISFAPGQAGADGTYGHVSIVEDVRKDGSILISESNCIGLGKISYRTFTAQQAEQLTYVIGKSKN

SEQ ID NO: 225 - protein, 995 aa, Streptococcus pyogenes
MDKHLLVKRTLGCVCAATLMGAALATHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 226 - protein, 185 aa, Streptococcus pyogenes
MIEASKLKAGMTFEAEGKLIRVLEASHHKPGKGNTIMRMKLRDVRTGSTFDTTYRPDEKFEQAIIETVPAQYLYKMDDTAYFMNTDTYDQYEIPVANVEQELLYILENSDVKIQFYGSEVIGVTVPTTVELTVAETQPSIKGATVTGSGKPATLETGLVVNVPDFIEAGQKLIINTAEGTYVSRA

SEQ ID NO: 227 - protein, 468 aa, Streptococcus pyogenes
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFAALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDGGRIDYVKKHLEVISDAISDGANVKGYFMWSLMDVFSWSNGYEKRYGLFYVDFETQERYPKKSAYWYKKVAETQVIE

SEQ ID NO: 228 - protein, 1165 aa, Streptococcus pyogenes
MKKKVNQGSKRYQYLLKKWGIGFVIAATGTVVLGCTPSILTHQVAAKTIVGLARDEAQQGDGNAKSGDGLQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKDVKTPTTDWPNGLDLSHKGHYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDRDKSVMTLKGDFKAQGAVYTVTFGEVSQVARQSWQLKDKLYAYDGELGATLAKDGSVDLALWSPSADTVKVVVYDKQDQTRVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPGNFEADAPGDVVQYIAAHDNLTLHDVIAKSINKDPKVAEEEIHKRIRLGNTMILTAQGTAFIHSGQEYGRTKQLLNPDYKTKASDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLVDAEQAGVTAIAKPKGVQFTKEGLTIEGLTALVLKVSSKTANPSQQKSQTDNHQTKTPDGSKDLDKSLMTRPKRAKTNQKLPKTGEASSKGLLAAGIALLLLAISLLMKRQKD

SEQ ID NO: 229 - protein, 440 aa, Streptococcus pyogenes
MKNYLSIGVIALLFALTFGTVKSVQAIAGYGWLPDRPPINNSQLVVSMAGIVEGTDKKVFINFFEIDLTSQPAHGGKTEQGLSPKSKPFATDNGAMPHKLEKADLLKAIQKQLIANVHSNDGYFEVIDFASDATITDRNGKVYFADKDGSVTLPTQPVQEFLLKGHVRVRPYKEKPVQNQAKSVDVEYTVQFTPLNPDDDFRPGLKDTKLLKTLAIGDTITSQELLAQAQSILNKTHPGYTIYERDSSIVTHDNDIFRTILPMDQEFTYHVKNREQAYEINPKTGIKEKTNNTDLVSEKYYVLKQGEKPYDPFDRSHLKLFTIKYVDVNTNELLKSEQLLTASERNLDFRDLYDPRDKAKLLYNNLDAFDIMDYTLTGKVEDNHDKNNRVVTVYMGKRPKGAKGSYHLAYDKDLYTEEERKAYSYLRDTGTPIPDNPKDK

SEQ ID NO: 230 - protein, 348 aa, Streptococcus pyogenes
MLTSKHHNLNKLVWRYGLTSAAAVLLAFGGGASSVKAEVSSTTMTSSQRESKIKEIEESLKKYPEVSNEKFWERKWYGTYFKEEDFQKELKDFTEKRLKEILDLIGKSGIKGDRGETGPAGPAGPQGKTGERGAQGPKGDRGEQGIQGKAGEKGERGEKGDKGETGERGEKGEAGIQGPQGEAGKDGAPGKDGAPGEKGEKGDRGETGAQGPVGPQGEKGETGAQGPAGPQGEAGKPGEQGPAGPQGEAGQPGEKAPEKSPEGEAGQPGEKAPEKSKEVTPAAEKPADKEANQTPERRNGNMAKTPVANNHRRLPATGEQANPFFTAAAVAVMTTAGVLAVTKRKENN

SEQ ID NO: 231 - protein, 188 aa, Streptococcus pyogenes
MILLIDNYDSFTYNLAQYLSEFDETIVLYNQDPNLYDMAKKANALVLSPGPGWPKEANQMPKLIQDFYQTKPILGVCLGHQAIAETLGGTLRLAKRVMHGRQSTIETQGPASLFRSLPQEITVMRYHSIVVDQLPKGFSVTARDCDDQEIMAFEHHTLPLFGLQFHPESIGTPDGMTMIANFIAAIPR

SEQ ID NO: 232 - protein, 542 aa, Streptococcus pyogenes
VSKYLKYFSIITLFLTGLILVACQQQKPQTKERQRKQRPKDELVVSMGAKLPHEFDPKDRYGVHNEGNITHSTLLKRSPELDIKGELAKTYHLSEDGLTWSFDLHDDFKFSNGEPVTADDVKFTYDMLKADGKAWDLTFIKNVEVVGKNQVNIHLTEAHSTFTAQLTEIPIVPKKHYNDKYKSNPIGSGPYMVKEYKAGEQAIFVRNPYWHGKKPYFKKWTWVLLDENTALAALESGDVDMIYATPELADKKVKGTRLLDIPSNDVRGLSLPYVKKGVITDSPDGYPVGNDVTSDPAIRKALTIGLNRQKVLDTVLNGYGKPAYSIIDKTPFWNPKTAIKDNKVAKAKQLLTKAGWKEQADGSRKKGDLDAAFDLYYPTNDQLRANLAVEVAEQAKALGITIKLKASNWDEMATKSHDSALLYAGGRHHAQQFYESHHPSLAGKGWTNITFYNNPTVTKYLDKAMTSSDLDKANEYWKLAQWDGKTGASTLGDLPNVWLVSLNHTYIGDKRINVGKQGVHSHGHDWSLLTNIAEWTWDESTK

SEQ ID NO: 233 - protein, 825 aa, Streptococcus pyogenes
VKKTYGYIGSVAAILLATHIGSYQLGKHHMGSATKDNQIAYIDDSKGKAKAPKTNKTMDQISAEEGISAEQIVVKITDQGYVTSHGDHYHFYNGKVPYDAIISEELLMTDPNYRFKQSDVINEILDGYVIKVNGNYYVYLKPGSKRKNIRTKQQIAEQVAKGTKEAKEKGLAQVAHLSKEEVAAVNEAKRQGRYTTDDGYIFSPTDIIDDLGDAYLVPHGNHYHYIPKKDLSPSELAAAQAYWSQKQGRGARPSDYRPTPAPAPGRRKAPIPDVTPNPGQGHQPDNGGYHPAPPRPNDASQNKHQRDEFKGKTFKELLDQLHRLDLKYRHVEEDGLIFEPTQVIKSNAFGYVVPHGDHYHIIPRSQLSPLEMELADRYLAGQTEDDDSGSDHSKPSDKEVTHTFLGHRIKAYGKGLDGKPYDTSDAYVFSKESIHSVDKSGVTAKHGDHFHYIGFGELEQYELDEVANWVKAKGQADELAAALDQEQGKEKPLFDTKKVSRKVTKDGKVGYMMPKDGKDYFYARDQLDLTQIAFAEQELMLKDKKHYRYDIVDTGIEPRLAVDVSSLPMHAGNATYDTGSSFVIPHIDHIHVVPYSWLTRDQIATIKYVMQHPEVRPDIWSKPGHEESGSVIPNVTPLDKRAGMPNWQIIHSAEEVQKALAEGRFATPDGYIFDPRDVLAKETFVWKDGSFSIPRADGSSLRTINKSDLSQAEWQQAQELLAKKNAGDATDTDKPKEKQQADKSNENQQPSEASKEEEKESDDFIDSLPDYGLDRATLEDHINQLAQKANIDPKYLIFQPEGVQFYNKNGELVTYDIKTLQQINP

SEQ ID NO: 234 - protein, 379 aa, Streptococcus pyogenes
MRRAENNKHSRYSIRKLSVGVTSIAIASLFLGKVAYAVDGIPPISLTQKTTATTSENWHHIDKDGLIPLGISLEAAKEEFKKEVEESRLSEAQKETYKQKIKTAPDKDKLLFTYHSEYMTAVKDLPASTESTTQPVEAPVQETQASASDSMVTGDSTSVTTDSPEETPSSESPVAPALSEAPAQPAESEEPSVAASSEETPSPSTPAAPETPEEPAAPSPSPESEEPSVAAPSEETPSPETPEEPAAPSQPAESEESSVAATTSPSPSTPAESETQTPPAVTKDSDKPSSAAEKPAASSLVSEQTVQQPTSKRSSDKKEEQEQSYSPNRSLSRQVRAHESGKYLPSTGEKAQPLFIATMTLMSLFGSLLVTKRQKETKK

SEQ ID NO: 235 - protein, 1181 aa, Streptococcus pyogenes
LRKKQKLPFDKLAIALMSTSILLNAQSDIKANTVTEDTPATEQAVETPQPTAVSEEAPSSKETKTPQTPDDAEETIADDANDLAPQAPAKTADTPATSKATIRDLNDPSQVKTLQEKAGKGAGTVVAVIDAGFDKNHEAWRLTDKTKARYQSKEDLEKAKKEHGITYGEWVNDKVAYYHDYSKDGKTAVDQEHGTHVSGILSGNAPSETKEPYRLEGAMPEAQLLLMRVEIVNGLADYARNYAQAIIDAVNLGAKVINMSFGNAALAYANLPDETKKAFDYAKSKGVSIVTSAGNDSSFGGKTRLPLADHPDYGVVGTPAAADSTLTVASYSPDKQLTETATVKTADQQDKEMPVLSTNRFEPNKAYDYAYANRGMKEDDFKDVKGKIALIERGDIDFKDKIANAKKAGAVGVLIYDNQDKGFPIELPNVDQMPAAFISRKDGLLLKENPQKTITFNATPKVLPTASGTKLSRFSSWGLTADGNIKPDIAAPGQDILSSVANNKYAKLSGTSMSAPLVAGIMGLLQKQYETQYPDMTPSERLDLAKKVLMSSATALYDEDEKAYFSPRQQGAGAVDAKKASAATMYVTDKDNTSSKVHLNNVSDKFEVTVTVHNKSDKPQELYYQATVQTDKVDGKLFALAPKALYETSWQKITIPANSSKQVTIPIDVSQFSKDLLAPMKNGYFLEGFVRFKQDPTKEELMSIPYIGFRGDFGNLSALEKPIYDSKDGSSYYHEANSDAKDQLDGDGLQFYALKNNFTALTTESNPWTIIKAVKEGVENIEDIESSEITETIFAGTFAKQDDDSHYYIHRHANGKPYAAISPNGDGNRDYVQFQGTFLRNAKNLVAEVLDKEGNVVWTSEVTEQVVKNYNNDLASTLGSTRFEKTRWDGKDKDGKVVANGTYTYRVRYTPISSGAKEQHTDFDVIVDNTTPEVATSATFSTEDRRLTLASKPKTSQPVYRERIAYTYMDEDLPTTEYISPNEDGTFTLPEEAETMEGATVPLKMSDFTYVVEDMAGNITYTPVTKLLEGHSNKPEQDGSDQAPDKKPETKPEQDGSGQAPDKKPETKPEQDGSGQTPDKKPETKPEQDGSGQTPDKKPETKPEKDSSGQTPGKTPQKGQPSRTLEKRSSKRALATKASTKDQLPTTNDKDTNRLHLLKLVMTTFFLGLVAHIFKTKRTED

SEQ ID NO: 236 - protein, 308 aa, Streptococcus pyogenes
MNIRNKIENSKTLLFTSLVAVALLGATQPVSAETYTSRNFDWSGDDWSGDDWPEDDWSGDGLSKYDRSGVGLSQYGWSKYGWSSDKEEWPEDWPEDDWSSDKKDETEDKTRPPYGEALGTGYEKRDDWGGPGTVATDPYTPPYGGALGTGYEKRDDWGGPGTVATDPYTPPYGGALGTGYEKRDDWRGPGHIPKPENEQSPNPLHIPEPPQIEWPQWNGFDGLSFGPSDWGQSEDTPPSEPRVPEKPQHTPQKNPQESDFDRGFSAGLKAKNSGRGIDFEGFQYGGWSDEYKKGYMQAFGTPYTPSAT

SEQ ID NO: 237 - protein, 484 aa, Streptococcus pyogenes
MAKNNTNRHYSLRKLKTGTASVAVALTVLGAGFANQTEVKANGDGNPREVIEDLAANNPAIQNIRLRYENKDLKARLENAMEVAGRDFKRAEELEKAKQALEDQRKDLETKLKELQQDYDLAKESTSWDRQRLEKELEEKKEALELAIDQASRDYHRATALEKELEEKKKALELAIDQASQDYNRANVLEKELETITREQEINRNLLGNAKLELDQLSSEKEQLTIEKAKLEEEKQISDASRQSLRRDLDASREAKKQVEKDLANLTAELDKVKEDKQISDASRQGLRRDLDASREAKKQVEKDLANLTAELDKVKEEKQISDASRQGLRRDLDASREAKKQVEKALEEANSKLAALEKLNKELEESKKLTEKEKAELQAKLEAEAKALKEQLAKQAEELAKLRAGKASDSQTPDTKPGNKAVPGKGQAPQAGTKPNQNKAPMKETKRQLPSTGETANPFFTAAALTVMATAGVAAVVKRKEEN

SEQ ID NO: 238 - protein, 541 aa, Streptococcus pyogenes
MKKRKLLAVTLLSTILLNSAVPLVVADTSLRNSTSSTDQPTTADTDTDDESETPKKDKKSKETASQHDTQKDHKPSHTHPTPPSNDTKQTDQASSEATDKPNKDKNDTKQPDSSDQSTPSPKDQSSQKESQNKDGRPTPSPDQQKDQTPDKTPEKSADKTPEKGPEKATDKTPEPNRDAPKPIQPPLAAAPVFIPWRESDKDLSKLKPSSRSSAAYVRHWTGDSAYTHNLLSRRYGITAEQLDGFLNSLGIHYDKERLNGKRLLEWEKLTGLDVRAIVAIAMAESSLGTQGVAKEKGANMFGYGAFDFNPNNAKKYSDEVAIRHMVEDTIIANKNQTFERQDLKAKKWSLGQLDTLIDGGVYFTDTSGSGQRRADIMTKLDQWIDDHGSTPEIPEHLKITSGTQFSEVPVGYKRSQPQNVLTYKSETYSFGQCTWYAYNRVKELGYQVDRYMGNGGDWQRKPGFVTTHKPKVGYVVSFAPGQAGADATYGHVAVVEQIKEDGSILISESNVMGLGTISYRTFTAEQASLLTYVVGDKLPRP

SEQ ID NO: 239 - protein, 398 aa, Streptococcus pyogenes
MNKKKLGVRLLSLLALGGFVLANPVFADQNFARNEKEAKDSAITFIQKSAAIKAGARSAEDIKLDKVNLGGELSGSNMYVYNISTGGFVIVSGDKRSPEILGYSTSGSFDANGKENIASFMESYVEQIKENKKLDTTYAGTAEIKQPVVKSLLDSKGIHYNQGNPYNLLTPVIEKVKPGEQSFVGQHAATGCVATATAQIMKYHNYPNKGLKDYTYTLSSNNPYFNHPKNLFAAISTRQYNWNNILPTYSGRESNVQKMAISELMADVGISVDMDYGPSSGSAGSSRVQRALKENFGYNQSVHQINRGDFSKQDWEAQIDKELSQNQPVYYQGVGKVGGHAFVIDGADGRNFYHVNWGWGGVSDGFFRLDALNPSALGTGGGAGGFNGYQSAVVGIKP

SEQ ID NO: 240 - protein, 271 aa, Streptococcus pyogenes
MNLLGSRRVFSKKCRLVKFSMVALVSATMAVTTVTLENTALARQTQVSNDVVLNDGASKYLNEALAWTFNDSPNYYKTLGTSQITPALFPKAGDILYSKLDELGRTRTARGTLTYANVEGSYGVRQSFGKNQNPAGWTGNPNHVKYKIEWLNGLSYVGDFWNRSHLIADSLGGDALRVNAVTGTRTQNVGGRDQKGGMRYTEQRAQEWLEANRDGYLYYEAAPIYNADELIPRAVVVSMQSSDNTINEKVLVYNTANGYTINYHNGTPTQK

SEQ ID NO: 241 - protein, 778 aa, Streptococcus pyogenes
MRFLELLQKKFFPKAYQEKQFLMHQKTRLTPQHNQKQYSPNANHLDSSATKNSEQDPATALQRSRAYEGSPKSRPAWLQKLEAVLPSPQRPIRRFWRRYHIGKLLMILIGTLVLLLGSYLFYLSKTAKVSDLQDALKATTVIYDHKGEYAGSLSGQKGSYVELNAISDDLENAVIATEDRTFYSNSGINLKRFLLAVVTAGRFGGGSTITQQLAKNAYLSQDQTIKRKAREFFLALELTKKYSKKDILTMYLNNSYFGNGVWGVEDASQKYFGTTAANLTLDEAATLAGMLKGPEIYNPYHSLKNATHRRDTVLGAMVDAKKITQTKAQQARAVGLKNRLADTYVGKTDDYKYPSYFDAVISEAIATYGLSEKDIVNNGYKVYTELDQNYQTGMQTTFNNDELFPVSAYDGSSAQAASVALDPKTGGVRGLIGRVNSSENPTFRSFNYATQAKRSPASTIKPLVVYAPAVASGWSIEKELPNTVQDFDGYQPHNYGNYESEDVPMYQALANSYNIPAVSTLNDIGIDKAFTYGKTFGLDMSSAKKELGVALGGSVTTNPLEMAQAYAAFANNGVIHPAHLINRIENARGEVLKTFTDKAKRVVSQSVADKMTAMMLGTFSNGTAVNANVYGYTLAGKTGTTETNFNPDLAGDQWVIGYTPDVVISQWVGFNQTDENHYLTDSSAGTASAIFSTQASYILPYTKGSQFHVDNAYAQNGISAVYGVNETGNQSGVDTQSIIDGLRKSAQEASQSLSKAVDQSGLRDKAQSIWKEIVDYFR

SEQ ID NO: 242 - protein, 732 aa, Streptococcus pyogenes
MVSLEEDKVTVQPDIKVIKRDGRLVNFDSTKIYSALLKASMKVTRMSPLVEAKLEAISDRIIAEIIERFPTNIKIYEIQNIVEHKLLAANEYAIAKEYINYRTQRDFARSQATDINFSIDKLINKDQTVVNENANKDSDVFNTQRDLTAGIVGKSIGLKMLPSHVANAHQKGDIHYHDLDYSPYTPMTNCCLIDFKGMLANGFKIGNAEVESPKSIQTATAQISQIIANVASSQYGGCTADRIDEFLAPYAELNFKKHMADAKKWIVETKRESYAFEKTQKDIYDAMQSLEYEINTLFTSNGQTPFTSLGFGLGTSWFEREIQKAILTIRINGLGSEHRTAIFPKLIFTVKRGLNLEPDSPNYDIKTLALECATKRMYPDMLSYDKIIDLTGSFKSPMGCRSFLQGWKDENGQDVTSGRMNLGVVTLNLPRIAMESNGDMDKFWELFNERMLISKDALIYRVERVTEAKPANAPILYQYGAFGKRLEKTGNVNDLFKNRRATVSLGYIGLYEVASVFYGGQWEGNPDAKAFTLSIVKAMKQACEDWSDEYGYHFSVYSTPSESLTDRFCRLDTEKFGIVTDITDKEYYTNSFHYDVRKSPTPFEKLDFEKDYPEAGASGGFIHYCEYPVLQQNPKALEAVWDYAYDRVGYLGTNTPIDKCYNCQFEGDFTPTERGFTCPNCGNNDPKTVDVVKRTCGYLGNPQARPMVNGRHKEISARVKHMNGSTIKYPGL

SEQ ID NO: 243 - protein, 255 aa, Streptococcus pyogenes
MRRNYSRVIDELRTDYGLNLVAIGQRLGTDPRTVGKWWQGKHNPNQESRKKLNRLYREVKETMMTQVNIFEEANDNTKQVMQVITTTNFHGQPLDIYGDIQEPLFLARAVAEMIDYTKTSQGYYDVQAMLRKVDEDEKLKGMALEGTTKNFRSGQKVWFLTEHGLYEVLMRSNKPKAKEFRKAVKNILKEIRLNGYYMQGELVQELAQPSTQKLPGISDLTYILNKLADLVDMDNLADISNGIDRVQQLVKLISL

SEQ ID NO: 244 - protein, 204 aa, Streptococcus pyogenes
MFKKENLKQRYFNFGLVALALTILAIIFAFSSKNADTKSYAKKSESKMVTIDKAPKNNHAITKEESKEKAKSIASEPIPTVENSVAPTVTEEVPVVQQEVTQTVQQVSSVAYNPNNVVLSNGNTAGIVGSQAAAQMAAATGVPQSTWEHIIARESNGNPNAANASGASGLFQTMPGWGSTATVEDQVNAALKAYSAQGLSAWGY

SEQ ID NO: 245 - protein, 858 aa, Streptococcus pyogenes
MKNNNKWIIAGLASFLFPLSIIFIILLSMGIYYNSDKTILASDAFHQYVIFAQNFRNIMHGSDSFFYTFTSGLGINFYALMCYYLGSFFSPLLFFFNLTSMPDAIYLFTLIKFGLIGLAACYSFHRLYPKISAFLMISISVFYSLMSFLTSQMELNSWLDVFILLPLVILGLNKLITENKTRTYYLSISLLFIQNYYFGYMIALFCILYALVCLLRLNDFNKMFIAFVRFTAVSICAALTSALVILPTYLDLSTYGENLSPIKQLVTNNAWFLDIPAKLSIGVYDTTKFNALPMIYVGLFPLMLSVIYFTLESIPLKIKLANACLLTFIIISFYLQPLDLFWQGMHSPNMFLHRYAWSFSIVILLLACETLSRLKEVTQIKAGFAFIFLIILTSLPYSFSQQYNFLPLTLFLLSVFLLLGYTISLFSFRNSQIPSTFISAFILIFSLLESGLNTYYQLQGINKEWGFPSRQIYNSQLKDINNLVNSVSKNSQPFFRMERLLPQTGNDSMKFNYYGISQFSSVRNRLSSSLLDRLGFQSKGTNLNLRYQNNTIIMDSLLGIKYNLSEGPPNKFGFTKLKTSGNTTLYQNHYSSPLAILTRNVYKDVNLNVNTLDNQTKLLNQLSGKSLTYFNLQPAQLISGANQFNGQISAQASDYQNSVTLNYQINIPKHSQLYVSIPNIIFSNPDAKEMRIQTDNHNFIYTTDNAYSFFDLGYFADAKVATFSFVFPKNKQISFKEPHFYSLSIESYLEAMNSIKQKNVHTYAKSNTVITDYNSKTKGSLIFTLPYDKGWSAQKDGKNLPVKKAQGGFLSVTIPKGKGRVILTFIPNGFKLGLSLSCVGIIAYMLLYKYIDIKSKLL

SEQ ID NO: 246 - protein, 44 aa, Streptococcus pyogenes
FSRFLPTRRDYSSLWSASCRNEHYNSQHHHGVGTVSSKQNPRPL

SEQ ID NO: 247 - protein, 12 aa, Streptococcus pyogenes
SFIWEKRNPEGS

SEQ ID NO: 248 - protein, 47 aa, Streptococcus pyogenes
KGEEKTEVTKEKLLELARWIKDISDDTDEKTEDEAYYDGDGTEETTV

SEQ ID NO: 249 - protein, 32 aa, Streptococcus pyogenes
LYQKKRLKKSQRLSKLMTSRLLNKALMTSKIE

SEQ ID NO: 250 - protein, 10 aa, Streptococcus pyogenes
FVLQKYSLWQ

SEQ ID NO: 251 - protein, 57 aa, Streptococcus pyogenes
PISMQKAIQVIAIMVEQNVWILSKRLLLNVLRNFSVPHLPMFKPIPEVKPMQQLIWP

SEQ ID NO: 252 - protein, 35 aa, Streptococcus pyogenes
FRNIFCDFSCCSSFVSCYQKLKRKGYNRTSKKRFL

SEQ ID NO: 253 - protein, 11 aa, Streptococcus pyogenes
WVTGCKWWFFC

SEQ ID NO: 254 - protein, 48 aa, Streptococcus pyogenes
LMLKAKKTNSKLVTLSQPTKKFNLQKLFNQTNLLKPLSLWVLLQTTLS

SEQ ID NO: 255 - protein, 35 aa, Streptococcus pyogenes
PRNGWGRFERYERLGRTRHDHVNCYSRNGICSPSS

SEQ ID NO: 256 - protein, 35 aa, Streptococcus pyogenes
LMNCPSLHFLQPKHKEQPVLKMLKNYESKKQIVFK

SEQ ID NO: 257 - protein, 84 aa, Streptococcus pyogenes
KTTKCNYLKRPKLVESRLQRTRFRRICSRKHGRYRRWIRRFLIFLTNKSKKILVKRRVKRLLLSLLVTAPKESKKMELSQFLIG

SEQ ID NO: 258 - protein, 19 aa, Streptococcus pyogenes
GRRLPPRLPQEKSKWLLPY

SEQ ID NO: 259 - protein, 62 aa, Streptococcus pyogenes
FWSPGSRYFVRDANDCQRTGFSKCDFSWGTKCRYFLKFAGFSSVRKNVSIVNTGCWSGRPCP

SEQ ID NO: 260 - protein, 51 aa, Streptococcus pyogenes
CVPSVKCSIMIQINTPLSILFPNTLVQAGVIFRVYPIGFPLFLLEWQKSQQ

SEQ ID NO: 261 - protein, 35 aa, Streptococcus pyogenes
SDYFRHHAPFLKWLRSAKNNSKDIRCPYYYANGIR

SEQ ID NO: 262 - protein, 65 aa, Streptococcus pyogenes
LLLLKQTSKLNLLLKANQKRSGTKSSQVKWTASCLTTLKLTKLTLFLHKFTSWTTAKLLKLTLTQ

SEQ ID NO: 263 - protein, 38 aa, Streptococcus pyogenes
HLFVKDVWSTLKIWERCSVCYKKVVKKQELWQPRLYQK

SEQ ID NO: 264 - protein, 19 aa, Streptococcus pyogenes
LYAPQSLSNPFLDSIPCDQ

SEQ ID NO: 265 - protein, 61 aa, Streptococcus pyogenes
NRRDFLDNVVNLIRVTEPLGTSLVFDNFINRAAHININNIGLGIGLNEISCTFQPFCVTTK

SEQ ID NO: 266 - protein, 18 aa, Streptococcus pyogenes
QAPLDDHHNKPTYWSGYL

SEQ ID NO: 267 - protein, 75 aa, Streptococcus pyogenes
YFLKKTPLKAAKSWLLSPFGEMAKTGFPWAFFSKINLPSAFLKVPSVCRPLSEIVLVDTLVSEPRVTSPVKCLPT

SEQ ID NO: 268 - protein, 65 aa, Streptococcus pyogenes
SKNKRNTDTGCNNGKGSKSVSHNHSKNNHAKHISENAKEAAISRYNLPNERSNHITNTSSCKNSS

SEQ ID NO: 269 - protein, 30 aa, Streptococcus pyogenes
LFIHRSRLILDFLVINFSLFVQIYDDFLNG

SEQ ID NO: 270 - protein, 12 aa, Streptococcus pyogenes
SFIWEKRNPEGS

SEQ ID NO: 271 - protein, 50 aa, Streptococcus pyogenes
IKHLTQAKQRMPVSKVLVANPLGSKGIADSIQLRMKPLAVKRYRSSLSTR

SEQ ID NO: 272 - protein, 50 aa, Streptococcus pyogenes
PPPPNLPPACKTVKTVSTAGRPVLAWISTGIPRPSSTTVMELSASIKTLI

SEQ ID NO: 273 - protein, 32 aa, Streptococcus pyogenes
ENEFNQYYQDAKYKSHKERLTINTFKRQGYLR

SEQ ID NO: 274 - protein, 37 aa, Streptococcus pyogenes
TRVAPYFPQALAIFSEPVTLIASFKAFPSSSAASTAV

SEQ ID NO: 275 - protein, 81 aa, Streptococcus pyogenes
SPFTKSVLTPSALKLSSIKRPVKPPKNPVAVLAMSKRCKMRLTLMPLPPANLSSLAMRFTDPRFIWSILTIKSIEGFKVTV

SEQ ID NO: 276 - protein, 23 aa, Streptococcus pyogenes
DHNIYWHYQLKLSQVQTMTFPPL

SEQ ID NO: 277 - protein, 21 aa, Streptococcus pyogenes
PNLLDHFLPNNPHQNHKAKLD

SEQ ID NO: 278 - protein, 39 aa, Streptococcus pyogenes
QCLIIINNINFRHNKNTPSCILKRASLHDIIFHAETLLW

SEQ ID NO: 279 - protein, 137 aa, Streptococcus pyogenes
EKLFRTARQRYNFKWVSKKQIMGLVLIVFLKSRNRNSESKLFFYHIFGHIDLSNASINNNQVRSLQSLLFHPTVPSKKHFSHTGIIIWSHHCFNLKFTIIFLTRFAINKNNHSRNWTCPLNVRIIKGFNAHRLVNPK

SEQ ID NO: 280 - protein, 30 aa, Streptococcus pyogenes
DNCRGCLSTNLDNKTHSFTARFVTNCCNTF

SEQ ID NO: 281 - protein, 33 aa, Streptococcus pyogenes
IGSINQLVSFALVTMDEVKTLFKTLITPTFEEC

SEQ ID NO: 282 - protein, 39 aa, Streptococcus pyogenes
YQVCQLPEGVPQLIVNADQTWFYKAKTKQRTKKQWRSNQ

SEQ ID NO: 283 - protein, 20 aa, Streptococcus pyogenes
ILAKIEISQKTLITIIIMRS

SEQ ID NO: 284 - protein, 46 aa, Streptococcus pyogenes
FPDVNDKVIARDSRFFGKERTCLLSNRFWEVGDKKVETNPNNDIGD

SEQ ID NO: 285 - protein, 45 aa, Streptococcus pyogenes
KFNVTLLPLCQNELVITLFLFIFCHLLLLNRGANISSQKVIKEVR

SEQ ID NO: 286 - protein, 57 aa, Streptococcus pyogenes
ETSALLAARFIRSADSPKIIICLSPKRSGTKSSNSLPRSRPPAIKIKRLLSKPDKAF

SEQ ID NO: 287 - protein, 36 aa, Streptococcus pyogenes
KRLDDCTLIFFWCINLNTLKRFTFDTINFFDDNFWT

SEQ ID NO: 288 - protein, 45 aa, Streptococcus pyogenes
EWLSQQHSHQFLHDKRSYLDTAFDKGKCTFHKKPVLLLRWSSYLG

SEQ ID NO: 289 - protein, 38 aa, Streptococcus pyogenes
HDHLSHQQSLKQLGNLGLDSKHNHQNDKYYKESAAHRG

SEQ ID NO: 290 - protein, 69 aa, Streptococcus pyogenes
VMLKAPVKLIFKTRSKSSSVILSINLSLVMPALLTKTSIEPKLSIASLTIRLASDASETSPEMVTTVTP

SEQ ID NO: 291 - protein, 57 aa, Streptococcus pyogenes
RELSRFSSSAILLKPLVKVPPNRTMAPPNPPAAPLPGIVCKSMVVWQKTFLAKLLAI

SEQ ID NO: 292 - protein, 36 aa, Streptococcus pyogenes
EHFQPNHQIGQKWKKERPKPTWSKSDVAHKQTYQSP

SEQ ID NO: 293 - protein, 64 aa, Streptococcus pyogenes
KSRSLRTSSITSSTVFSSPTILVLSPSLVNICSGAFCWDSGLAHHGHLKGQPFKKTVVRIPGPS

SEQ ID NO: 294 - protein, 16 aa, Streptococcus pyogenes
RNEINTSSPTLSSTKI

SEQ ID NO: 295 - protein, 23 aa, Streptococcus pyogenes
CSLAAFTKFSKSAIVPKSGLTAV

SEQ ID NO: 296 - protein, 46 aa, Streptococcus pyogenes
EAMSCQRCCSFLADSSLIRYDLAKSSVVIAAMIFKMAWLSCGRRCG

SEQ ID NO: 297 - protein, 44 aa, Streptococcus pyogenes
NFKARPPGVVSGFPNITPTFSRNWLIKIAIVFVLLIEADNLRMA

SEQ ID NO: 298 - protein, 38 aa, Streptococcus pyogenes
KETCHYSHQHHVIFQAKFDRNFLPHPDKSGHQNCSIDG

SEQ ID NO: 299 - protein, 78 aa, Streptococcus pyogenes
ITLLTKQTQQLFRKPSLSNNLLKHLLVKRMSLSMFLKQKHQLTKPKASMLRPQNNKTTISFHHGGDQTIKIHGPTLTS

SEQ ID NO: 300 - protein, 20 aa, Streptococcus pyogenes
SGRQDSNLRHLGPKPSTLPS

SEQ ID NO: 301 - protein, 36 aa, Mus musculus
  PEPTIDE (1)..(36): Peptide derived from mouse cathelin
RLAGLLRKGGEKIGEKLKKIGQKIKNFFQKLVPQPE

The invention claimed is:

1. An isolated S. pyogenes polypeptide consisting of amino acids 31-345 of SEQ ID NO: 215.

2. A fusion protein comprising an isolated polypeptide according to claim 1 and a heterologous peptide consisting of 1 to 10 amino acids.

3. The fusion protein of claim 2, wherein the peptide consists of 5 to 10 amino acids.

4. The fusion protein of claim 2, wherein the peptide consists of 1 to 5 amino acids.

5. The fusion protein of claim 2, wherein the peptide consists of 1 to 3 amino acids.

6. The fusion protein of claim 2, wherein the peptide consists of 1 to 2 amino acids.

7. A composition comprising:
   a) an isolated S. pyogenes polypeptide consisting of amino acids 31-345 of SEQ ID NO: 215; and
   b) a pharmaceutically acceptable carrier or excipient.

8. A composition comprising:
   a) a fusion protein according to claims 2, 3, 4, 5, or 6; and
   b) a pharmaceutically acceptable carrier or excipient.

9. An isolated S. pyogenes polypeptide consisting of amino acids 247-260, 9-33, 41-48, 57-79, 97-103, 113-138, 146-157, 165-186, 195-201, 209-215, 223-229, 237-247, 277-286, 290-297, or 328-342 of SEQ ID NO: 215.

10. A fusion protein comprising an isolated polypeptide according to claim 9 and a heterologous peptide consisting of 1 to 10 amino acids.

11. The fusion protein of claim 10, wherein the peptide consists of 5 to 10 amino acids.

12. The fusion protein of claim 10, wherein the peptide consists of 1 to 5 amino acids.

13. The fusion protein of claim 10, wherein the peptide consists of 1 to 3 amino acids.

14. The fusion protein of claim 10, wherein the peptide consists of 1 to 2 amino acids.

15. An immunogenic composition comprising:
   a) an isolated S. pyogenes polypeptide consisting of amino acids 247-260, 9-33, 41-48, 57-79, 97-103, 113-138, 146-157, 165-186, 195-201, 209-215, 223-229, 237-247, 277-286, 290-297, or 328-342 of SEQ ID NO: 215; and
   b) a pharmaceutically acceptable carrier or excipient.

16. An immunogenic composition comprising:
   a) a fusion protein according to claims 10, 11, 12, 13, or 14; and
   b) a pharmaceutically acceptable carrier or excipient.

* * * * *

UNITED STATES PATENT AND TRADEMARK OFFICE
CERTIFICATE OF CORRECTION

PATENT NO. : 7,638,136 B2  Page 1 of 1
APPLICATION NO. : 10/548463
DATED : December 29, 2009
INVENTOR(S) : Andreas Meinke et al.

It is certified that error appears in the above-identified patent and that said Letters Patent is hereby corrected as shown below:

On the title page, item (54) Title, delete "PYOGENE" and insert --PYOGENES-- therefor.

On the title page, item (57) Abstract, line 5, delete "therefore" and insert --therefor-- therefor.

In column 1, line 1, Title, delete "PYOGENE" and insert --PYOGENES-- therefor.

Signed and Sealed this
Twenty-second Day of March, 2011

David J. Kappos
*Director of the United States Patent and Trademark Office*